United States Patent 12,642,819 (COMPOSITIONS AND METHODS FOR TREATING INFLAMMATORY BOWEL DISEASE) - sequence listing, part 55

SEQ ID NO: 23 - DNA, 2305529 bp, Bifidobacterium longum
aacgcgcgactgggaggcaagtcacccacctatagcgccatcgtcgacgtgccatcatcggtgaacatacaagtcgtcacggctttgcaggaacgcctcgcgcatttccgtccgggaatcgcatcggcgcaatatcacctcaacgacctcgccatatgggcgtcgtccgatgacggcaacacggagatacgccgcgtcaccatcatcatcaccgacgccgaacggacaagaatcatgcccgcccccatcatcgagggcacatggctgaccggagcggacgaacccgccacgctggaaaccgcagtcaacgaaagcgcccgccaatacgtgcacgatggcaccgtggcactcgcccggacaggaaatccgcaacaggtgccggcacgggtgaacggtgtcatcgccgacgggacggacacacccaccatctacgtcaacgcgaccacactgcaacgctactggccgcaagcctgggaaccggatgggctgaccatcctcgtccatcccaatgaaggcgtggacgatcaacacgccaaaaccgtgttggacgatctgttgtccgacgtcgagaccggcagcatatcgtcatggaaccgttccgacaacgccgatgattacgagcaggtcatcggttttctccaactcggcgtcaccgtcaccgcgatattactgttgtcggtatccgccatcggcatgatcaacatcggattggccggcatcgagcaatgctcgcacgagctgctcatccgccgcgcactgggcgcgaccagagccagcatagccatacaggtcatcggctcgtccgtgctgctcggcctcatcatcgccttcgccgcggtgctcatctccgcggtgctggtctgggcaattccgtggatgatgcccgccgactcgccgctggaaccgcccgcatacccatatacggcggcgatgattgcggcctgtgcgtccatcgtcacctcgcttgtcggctctcttgccccggccatcaaagccatacggctgcaacccgcgctggcgttgcgatgaaccagaagccattctggacaagcccgccgacagctggatggtcggcattccgatcatcgattgcatccggtaaacgatccgcttgcgggatgtgtaccatggtcgagatgtcgcaaccgcagaatgttgactactagcatacaaatacatactattgtcttacgtaatgatggtggaggttaatgtgagcatggcatccgtcacagtccgcgtggatgcggacaccaagcagaaagccgcaaacatagccgaggatctcggtctggacttgtcttcggtcacccgcgccttctacaagcagattgtccgggagaagcgcattcccctaaacctttcctatacgatcgtgccgcctgaaaccatggaggcccttgacgaggcgaagaacaggctcgccgacggccaacctcgcttcaacagtgccgatgagatgttcgattcgttgggaatctgatcaatgctcaaaccggattacacggcggcattccagcgagatatcaagaagctcaaacgcaagcacactgatttacgcccgctgaaagaagtcattcgtctggttcttgaggacacggcggactccaaggaagtattgaggcgtaggcatcgcgcccacacacttaccggtgatttaaacggcgtactggaatgccacatcggcaatgccggcgactggctacttctatggattcgcgatgatggtaccgccatgttcatgcgaaccggcagccatgacgaactgtttgggcaaatagcgggtttacatcctgctttgaaccagccgacggcgatttgagtgcggcagccggcccgtgcccgcagaagccggcatcgccgcgcagcgtgccggtctgcaatcgctgatcgacgaggaggagtccagactcgaagccccgggattcaccggcgacaacctgctcgccgaaccacaccggccgctcacgccggagaccatgcgactgctgtcgggcctgctggcggaactgtacgcgaacatcgccaaacacacagatccgggcgaattggtgcgccatctgcgtcaccttcgacacggacgccattcacgtctccgccagcgacaccatcgcatccgatgacacgagactcggcctgggcagcggcctcgaccgctaccggaccatcatcgaaacacgcggcggcaccttccaaacccgcgccggacaagcccactggcagctggatgtcagcattccaatcgatggcgaccggtaaaacatgcattcgcagaccagccatgtcaagcaatcgcatgacagcatattcacgcaggatcgcgcctcatttcggctgatcccgcacgccctgttccgacgcgaattgttcggcgatttgccgtgcgtggatgttcttggcttcgttaacgaagtcggcgcatgccttgctgccgtagagcgcctcaccacacgggtcagcgaaacgcgggtcgccggccagcgcggagcggatggccccgagcgagccggacagcggcatggcgttcatcacggtcgcggtttgattctgcgcctcctgggtgcgggcggtcttgatgtcccggtccaggattcgttcggcgtattgcacgccaacatcaaaaaatgcaagaggctgaaagacctggctgcttcccttcacgatatctactgttctgatttgaccggcccagtcgtatatatcctgaaataattgtcgatgaatctgctgcagttgtcgcaaagtaccttgagcgacaggaagattcgattggaattccaacattctggcagatacaagatcgttttcagccgcttcaagttctgtaacggttgtggcaccgataagattgcgcagtacgtttgtgccgggaatcagatatgtgtcaaaggtttcgggcagttcaatcacacggattccagaccgtatcggcgacgtgtacgattaaccaattcgtgtgcgtctatttgttcttcgatatagtcgcgcgcgtctgcaaaaaacgaggatgtgacaccgccgccttccatacgggcagaatggacggcttccgccactctcatcgcacgtatctcttgttccgtcatgtcaacctcctcattgcaaacaatcatacctaccggaataggttcctgcagaatcggcaatcccgttccgaaaaagcgaatgcactaatcaaaagacactcgcataaccaccactacgcatcgccaataacataccgatgagccagaatgaggccccggccatgatgctaatccgtgaatgacgctggtcagagtggcaggtacattggtcttatggctaagcgcaaacataccggcactgttgttattgcaatactggtcgctattctgctggcggtgggcgtttccggctggctgttctggcagtcggtacaacgggtgatcggcgaggcgcagcaggcgggcgaatatgcggctgaagcacagcaatccgtcgggcagggcgacttcaagcaggcgcttgagcagatggacagcgctggcagtcacatcgtcgcggcgcgagacgaaacccagggcatgctatggcaggccgccgaatacgtgctgtattacggttcggacgtgaaggcggtgcgcggcatgctggatgcggccgccgacgccgcgaccaacgccctgcccaaaatcgacagtgccgcgcagggcacgttggtggacttcaatatcgaagagctgctgtccggcatgaacttctccgacggcacgctttccattcccaaaatcgcttccatcaagcaggacctgtccgacgccggtgcggtcttgaagcgcgtcaagacgtcgattcatgcggtgccgcaaccccgcacggaacagatcaccgaaatggtcaaccagggcaagcaggtagtggaccaaatcgatgagactttcgacaccttgaacaccatcgtcgaaaagattccgggctgacgttggttcgttcttgtcgtatattggcgtaacctccgcataaggctagtccatacaaatttaaacataaataacatatcgtgcaatgatgggagaatttattatttattatcgtggaaaaatcgttggcggtatatatgatgataggttacttgtaaaaccaacaaagtctgcaatttcttatatgccgacagttacttatgaaattccatacgaaaacgccaaagaaatgttattggtggaagaagttgataataaagattttctgacggggttatttgatgtgatgtatgatgaactaccaacgccaaaacctaaaaagaaaaaataaacagcttctagtttacaatttcatatccatatacacaaagcagttagttttaggattgactgctttttaaaaagacaccatttaggtgtaatgatgtcttttgggtgttattttataggtcatatcaaggctcattcaatcgtggtaaattcgtggtaaaatgagttttttctatacttcaaaatacttgaaagtatagtgtttatgcggataatcgaaaattagatataaaatttatgtttaaatttgggataggaggtgccaatatgccgacacgcacaccaatcccggtcagtcgggcgatgcgtcagatatccgtcaacctcgatttggcgcgcagacaacagcgcattcccgtagccttgctggccgagcgggctggattatccatgccaacggtcaccaaaatgctgcgtacgggtaatggcagctttgagaacttcctccgcattgctcgtctgcttggactgctggacggcgtacagcaagcgacggaccctcttaacacagatatcggcaaattacgcgccgacgaagacactccaaaacgtattcgatagtacagcaggaggcgcaacacatcatggaagcaatcgtcaccctgcagttcaacggcacagacgtcaccgtcgggaaattattcaccagtatcaggcgcggcatcgaatcggcacatttcacatacgatacggcctatatgcgctcttcaaacgcagtatccctctgtccagagatgcccctctccccccggaacgttcccggccgagcataatgcgatgcatcgcatctttcaagactgcatgccggatcgttggggcaggaacctcatgcttcgtgcagaacatcaagatgctcgttcggagcatcgcacagcacgcacactatttgagggagatctcttgctatccgtcaacgataagacccgacaaggcgcattgcgcttctggaacaacgacggtgacgcgctagcccccccagtgagaccggcggtccaagagaagtgaccattcagtcccgcatccatagcaatgatgagcagctgctttgaatccggcattgcgcggcttcgcgaagcaaacgcacaatgacttcacattcccgccttgcaccagctggctgcaatctgcgtatggtcatgtatctgtaggccggcacgaatgcggctgatgggtgcggcgaatcgtgacattgcttattgcccattcgccccttcagtcgtaccattcgggtcgtcgcagttccaggaatggccgctgtttgcgcgctgctgcggtctgtgtgagatcgatgtcggcgataatcaactgttcttggtcgtcggccttgctgacgacgttgccgtacgggtccaccaccaccgattggccggcgaacgtcacatcgccttccttgccgacccggttgcacatgacgatggccacctggttctgcatggcctggacacggattttccacaggaacggcttcgacggttcggcgtcagtgttcggaaccgatgctcgccgtcggcacgatgaccaggcggcgccgcgcaacgcgcatgtgcggatgccttcacggggttcactcaaatagcgtcatccagtcgggatcgcggtgggccgcaaaacacatggcgatttgttccgcggtgtttcttgtttccgaaagccgcggcaaccggtcttcctcgaagtagcggatttccgtcgtttcgatgttggccgagaaccaaccgccggcgcggctgcacaatacgaagaacttgagcaccccgtacggataggtcagcgcgttgtgattggcgcagtcctgcaccgcgatgagtcgctcgcccctcacatcgagcccagtctcctccttgacctccttgacggcgttggaccgaatggactggttctcgtcgacccagcctccgggcagtgaccattccccgctgttctcatgcgtcatgaggatcctgccttcttcatcgaagatggccgcacgagtgtcgagtttcggcgtcggatatccggcgctgagcagtcgactcacctgtccggccggcgcatcaacctgcgtggagagcatgtcgaccgccatcgcgcggatacgctcgtagcgctcccggtcgaaggggtccttgcagtacatcagtccggtctgggccagcgcctgcaattctcgggcctgttccagtaatgtgcggttcgtggccatcatcgttcatcctgtcatcgtaaggtcttggatccgtttgcactcaggcatcgcagcgtagtgcaagcagtatagcacttcgaaccgttccggggacgagggtctcagcgcatcccccgtaacctctcccatgtgccatcaacgcttggcgagctgcacgttcttgcgctgtctgcgattgcggctggcgaccgacttttcacgctcgcggcgcacgtgggcctcctcacgcgcggccgccgcgcgctcttcttccaaagacggcaatccggaggcggcgcggtgccggttctcccgctcatggtcgcgttcggccttgcgctccccgcctcggatccgggcgccggaaaccatcgcagttggcagagcgtctggccgaagttccacaggttattggtcagccagtacagcagcacgccgaacggcaaggtgccgcccgacaccacgtagatggccgggaacacaaacgcggtcagcttctgcgtgcggaactgcggtgaatccatggcgtccttcggcgtattgcgatggatgagcagccactgcatcgcgaacaacatcagacacatcaacgccacggccacgccgatgacgacgtgcgactgcggcgagacgaccgtgccgaacgagtcggcgatgcgcacgccgaatatggacgatgattcgatgtcgcccgccatgacgcggtcgatgccgctcaacggttccgcattcccggcggcgcttgcgggcagggattgcagcgtgtagaacagcgagcacagaatcggcgcctgaatcagcgaagcaggtatgaaccgagcggattggcgttattccgctgctgcaaagccataatttcacgttgcatggcttctttggaacgcggatccttacgcgcggcgtacttgcgttggatacgttggatttgcggttggagcacctgcatacgctgcgtcgcgcgcatttgggagaagaagagaggcaatagacagatacggatgatgagcacgaggcacataatcgcgatgcctaagctgtgcggcaccgactccttctacggcggcggcatggtcaccggccagcccatcggcaccatgatcggctctcgcatgatcaacaatgcgcaagccggcttcatcatcggcgccgtgatcatgggcttccggattcgtggcgcttgacatctgacctcgcgaggaatcctcaaaggacatggaacgcaccaagatgacgctcaaggatctcgctgtctccttccacttcccgaagttctccacctcgcgtgacttctacaaggcgttcggctgccgagtgtgcatgttgctcagctaccagatgatctccgtgtaccaactctacatcgtcgaggattacgtgcaccagaccaagaccgaggctgccggcaccatcgccaccatgtccatcatcaccatggtcgtttccctgaccgcttcgctgatctccggcccgatctccgacaagatgcacacgcacaaggtaccagtcatcatcgcctcgctgctgttcgcgattggcaccgcgatgccgtggatcatgccgagcgtcacgggcatgtacctgtatgcgggcatcgccggcttcggctacggcgtgtactcagccatcgaccaagcgctcaacgtcgacgtgctgccgaacaaggaagaggccggtaagggcctcggcatcctcaacctggccaccacgctcggccaagcagtcggtcccaccatcacctccgtggtcaagaccacgaccggcacctacacgccggcgttcgccatctccatcgtcatggccgtgtgcgctgccgtgttcgtgctgcgtatccagaaggtgaagtagccgctgcgagtgcctatctccgtttcaaggggctgattttgactttgcggaacatctacttccgtttcaaggggctgatgccaaagtagccactggttaaaaacggcggaatagcgatagaacaatgccatttctatctgcgttccgccagttgaccagccccttgaaacggaagtagacctccggcaaacgccaaatcagccccttgaagctgattttgactcagcatcatgcagcgcagctatatcctcggtgcgggtatactattccgggccgtcacgacgacgcctatggaacgcacgcatggcaaagagagaaacatgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtgatcggcaccggcctgttcctgagctccggatacaccatccagcaggcgggccccatcggcacaatcctggcatacagcatcggcgcgctcatcgtctatctggtcatgctcacactcggcgaactgtccgtggccatgccggtgaccggctccttccacgtgtatgccgaaaagttcatcggccctggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccttaaacgccttgtcggtgcggctcttcgccgaagcggaattctggttcgcctcgatcaaggtgttcgccatctgcgcgttcatcgtcatcggatcgctcgccatcttcggcgtcatcccggtcgccggctaccaacatgccccgatgttcgtcaatctcatcaaggacggcgtcttccccaacggcttcatgccggtgttcgccacgattctgaccgtcaacttcgcgttctccggcaccgaactcatcggcgtgaccgccggtgagacgagggacccgcaaaccgccgtgccgaaagccatccacaccaccctgtggcgtctggtgctcttcttcatcggctcaatcaccgtgatgtgcgcgctgatcccgtggcgcaaggccggcgtgggcgaaagcccgttcgtgctcgtgttcaacggcataggcatcccctatgcgggagacatcatgaacttcgtggtgctcacggccgtgctctccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggagtccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactgaacggctcgcgacctaccggcgcaccgctattcgcgccgtgaacgtgcactgatccaacgcaatgccagacccagcaaatccacaccgccacgattgcccatgatgtgggtttgagcgcggccggggagaacggcagcacctgcaggccaatgatgattaggccggcggccagcagcgaagctgagatgaccataccgaacttcttccagtcaaggccttcgcttgcctcttcggcactctgcggaatcgtgtcgaaaccggtgtagaagagcggcgtcatcaccagcactccgggcagaaacgacccgaccatggtaaccgcgccggacgtcgagccgatcggcagcagaaacacggcgcccagcacgaaggcgatcatcgcctcgaccgggccaccgccgacgatcatccagtcaccgaccagcagcacccatacggtgccgatgattgcgccgaatcccatggtgaagtagttccacaggctcagcgatctgaccatgccgccgtcgtcgccgctgccatcggcactactgtcgccgttgccgttgttaccatcctcgtgcacaggaatagcggcactgggcaggccagtcgattccaccaaactggccgtcatcgtgcttgacgggctgaatgccgtggatgcggcgaccatgaccgagcctcctttaattcggcctgactgtgatgataacgccgttcacgatatgccgtattatgaacgcagtgagagcccgcttcaccggccctattcggctcatgaataaacttcgcctatctgcggcactgaacacatgaccatagtgtgatacacgtcacttcctgaagtacgtagtcgttatggaatcacccgcacgtttcccgtatcggagctgtacgatagctgtgagacaggggggtcgtcagatttcgggggggagggttccggtaacggtccggctgcaggatgcaccggaccgtgcggcacgtatcaactcgtggattcacgccaaactcagttcagtatgccgattctcgtaaatggccagaagcggaacaacgccacaccttggatatcgtcgtatggcactagcccattgttgccgtcgtcaagatggtatcgagaatctctggaattggagcgattatcaccaagcacgaacacgttgccgtcagtaacggttacggaaaaagggctgtcgcttggattcacgccggacttaagataagcgctttcatcaatgggtttgccgttgaccgtgatgggctccccggatcccttgcaggcgacggtatcgccgggcagaccgatgacacgtttgattaggtaacgattgctgtcgattatcgacatcagattggtgggaagctgctccccctccatccagtctgcgggatctttgaacacgatgatgtcgccacggtgcagtgtaaagagtctcggagtcaatcgcgaggcaaatacgcggtcgccgatttgcaacgtgtcttccatgctgcgggatggaatcacatatacgttgaacacgaaggtacgtcccagcaacacgaccagcatcaccgcgatcactgtcagcagatagccgcgaatttcgctccaaacggagggctttcgcgcatatctcctcgactggccacgcgcttttttgctatgacgccccaccatcacatcctttccgaccgataacgcaacaccatagtcctcaaaccatgccgttacctacgcatgtttgagctcagctgtcacaccagcggttcgcgcacgtccagttcacaggcgatgccggtttccttgcgggcccattcggccgcctgcagtgcggcgatgttccataatgcgcacggcactccgccaaggtccggatgcgatgcccagaatgtgaggtcatcagcgtatgcggtgatgaccgattcttccgtgactggcataatcgtgtggtacaggcggtccgcaagcgtggccacgaattcgttggccgcggcgaacgtgtcgatgagatgctgttcggcggtcaccggcgggccgaccagctcccaggattcgacatccgtggcgctccaatgcgcggcttcgccgtccacttcacgctgcaaagagacgaacagcctggcgaactcatccgaagtcagtcccgtaacccggcgtcgggttgacaattcaatcggagtcatcagataccgttcctttcgcttcgttcattccgttgtttcgctgcttggatttgctgccagccggcacaaagcccatctcgcacacctcacgatagcccaaactaccggcatggccatgattgccagccctacgaccagtagccatgaggagccggcgtaatggcctcatcgagcattgtcggatgattcgcgtggcccacaatcgagacagtatcggtttccgttcggttcgtgcggccagactatcgcccgttcttgccgattgcctgtgagcaggttcggatagactggcgcgagaacaatgcgagaaagaggtaaggatgacccggaaacagtcgcaacagcacgacgcacaacgcaaaccgtcctggcgcgtacgctggaaaaccatgagccgagccgtgggcatggaaatccgcgaacacaaaagctcattcgcggtctatgtggtgctgcgcatgctggtgctcgccatggcaatactccagttctttaacggcgactacgaaaatgtgttcctgtgcatcctgacgttgctgctgctgttggcgccggcgttcatccaggtgcagttccgcatcgagctgccttcggtgctggaagtcatcgtgctggtgttcgtgttctcggctgagattcttggcgagatcagttcgttctatgagatcttcccgttctgggacacggtgttgcatacgatgaacggcttcctcgctgcggcgatcggcttctcgctggtcgacctgctcaaccggtccgaccgggtgaagttcgagctttcgcccctgtatctggcgatcgtgtccttctgcttctccatgaccatcggcgtgatctgggagttcttcgaattcggcatggaccagttgttcgggttcgacatgcagaaggacgccatcgtgcattccatcagctcggtgatgctcgaccccacgcacaccaaccatgcgattcgcatcaacgacattacccaggtcacggtcaatggccaagacctgggcctcggcggctacctcgacatcggtctgatcgacacgatggaggatctggtcgtcaacttcatcggcgcggtcgtgttctccgtgttcggtttcctgtacgtgaagaaccgcggcaagaaggactccatcatcagtcgtttcgtgccgcgccgcaagtccgccgaccgcgattatctgcgactggtgatcgatggcgggagccgggaaagtcatacaaatatgagagatacagtaatcgaacaaacgttcgactgccctgataaactggatgcataatttagcgacgacaacgacatgatttacagacgcccgaaaaaagaaaggcgatctcatgactggcgaggaactgaagcggcagattgctttgtatgagagcgcggaccacaccgtgcacctcgatgtgaaggtagacgaggacacggtgtggcttaacagacagcaattggccttgctgtttggccgcgatatcaaaacaatcggcaagcatgtcggcaatgcattaagggaagagctcaatggattttcagttgtcgcaaaatttgcgacaactgcatctgacggtaagacataccaagtcgagcattacaacctggatatgatcctgtcggtcggataccgcgtcaaatccaaggaaggcatctatttccggcgatgggccaactcagttctgaagcagcatctcgttgatggttataccatcaatcgcaagcggcttgacgcacttcacgccgtcgtcaaggtgctatcgaggtccaccgaaccggaaattgctggcaccgccgagatcttggaacgatatttgccgagtcttgtgctgcttaacgactatgacacaggcaatgtccctatacccaagggcgacgagtcccagtgggtcttgacctatgaggacgcgatgctgttcatccggtcgatgccgtatatgccaatcactgttgtgtttgcgaactccttcgctcatggtgccgaaaatgcatacatttggttattcgctgtttgcggtggggcgtgcatgggttagtgtttcgggttcgattccctgtcagaaaaaataatcgagtgcgggattacggccggtaaggctcctgtcgtggatgcggatgcgcgccggtcttacggtggtgctttcccgaaacgtggattgcacgaggtgtgggacggcacgcggattcggccgttttccgcccgccgtcccacagcgctcgctatgaacggttgtggataatcatggagctgtagcggaaatcggcgttattccgcggtttcgacagttaatagaacaaatagaacaaatagaacagccagcttaggcacggcgcggcaaatggcgcaaaccggccgcgatagtagtagcgtggtgcataccagtacaaccatgcgaggagaacagccatgatcaatgaggaatacaaggccatgcttggcggcaagtccgtgattcgcgagctgagcgagtacgccacgagccgcggtgccgaaatcggctaccagaacgtgttcgattacagccttggcaatccctcggtgccggctccgaaatccttcaccgacgccatggtcgacctctacgaaaacggcgatccggtggccatccacggctactccccctcgctcggtatcccatccgtcaaggacgcgatcgccgaaaacctcaacgaacgtttcggcatggcatacaccggcaaccacatcttcccgaccacgggcgcggcgggcgcgctgtcccacgcgatgcgtgcggtgaccaagccgggcgatgagatcatcaccttcgccccctacttccccgaataccagccgtacgtcaagggcgccggcgccaagctgaccatcgtgccggccgacaccgagaacttccaaatcaacttcgacgcattcgaggctgcacttaacccgaacgtgcaggtcgtgcttatcaacaccccgaacaacccgtccggcgcggtgtattcagcggacacgctcaagcgtctggccgcgatcctgaccgccaagcaggtcgaatacggccacgatatcttcctgatcagcgacgaaccgtaccgcgaaatcgtgttcgacggcgccacccagccctacccggccagcttctacgcgaactcgctgacctgctactcgtggtcgaagtcgctgagcctgcctggcgaacgcatcggctacgtcgcggtgaatcccacagccaccgacgccgacctgctcgtgcccatgatgggccagatctcgcgcggcaccggccacaactgcccgccgagctcgattcagctgggcgtggccaaggtcatcgaccagaccgccgatctcaacgtctacgagacgaacatgaacctgctctacgatgcgctgaccggcatcggcttcgacgtggtacgccccggcggcacgttctacatcttccccaaggcgctggaggacgacgccgtggcgttctgcatgaaggccaaggaatacgacctgattcttgtgccgtccgacagcttcggcgtgcccggatacttccgcatggcctactgcatcgacacggagaaggtcaagcgctcgatccccgtgttcgaaaagttcgcccacgaggtgtacggcctgtaaacacggaccgcaagtaacaaacacaagaaaggggttgccatggaatacaccgaagacgccgatcgtcgcgaactgctgctgcacagcgcctatgactccgatacggtccgggccatggagcgacccctgctggacaaaggcgtgccgctgatgcgcatggccgcccaggccgcggcccacatggcggccggtatgctggacgacgaggatctggcgctggaggacacgtcgatcgtgctgctggccggggccggagacaatggtggcgatggtctgttcgcggccgccgcgctggcccaggagggcgcgaacgtcaccgccatcgccgtgggccggtcgttgcatgaggccggattcgcctcattcgtgcgcgccggaggcaaggtgctggtgcttgatcccgcggctgatattcccggttgcgcgtccgggttttccgccggtgaggccggcgagcgattgcagaccgccatcgccgtggccaggaaatcgcatctgatcatcgacgcgatgaccggcatcggcatccaaggctcgctacgcggcatccccgccgcactcgcctccgcccttggtctcgacggcgaggctcccgatgagcccgccctgccaaaccgtgagtcgtcaggcgattttccgctggtacttgccgtggatacgccatccggcgtcggtgtgaacgatggttctctgcccggcccgtacattccggccacggtcacggtcacgttcggcgcgatgaagccgtgcgcggtgctgccgcccgccacgttcgcctgcggccgtatcgagttgctcgatttcggattcgatatcgacgacaaagatccggacgtcgaggtggtggataattcgttcgcgtccgacgcggtccgtctccccagggtcgaggattccaaatactcccggggcgtggttggtctggtgaccggctcgcagcgctaccccggtgccgccgtgctcaccgccagcgccgccgcccgcgcgaacaccggcatggtccggtatctgggcccggagcgcgcgcagaacatggtgctcgccgcactgccggaagccgtgatcggcaagggacatgtgcagtcctgggtcgtggggtccggcgtgcccgaggctagcgtcgagggcaccgacggcgatatgcagcgggacaccatcgccgcattgctcaagcattacgcgctcggcagcgaggatgagaacaaggacgcctacgacatgccgccaatcgtggtggatgccggcgcactcgacctgctgccggagcgtgtgcccggccaggtggtgatcacgccacatgccggcgagatggcgaaactgctcaaccggttcgaaaccgccgccagcactgcggagcatgccgattcgcacgagccgtacaccgccgacgacgtgcggttgaacccgttggccagcgcgaagcgtgcccacgagctcaccggcgccaccgtattgctgaagggcgcggtgaccatcgtggtggatgaggaccacgtctatgcgtcgggtagcgcaccggcctggctgggcaccgccggcgcgggcgacgtgctggccggtctgaccggcgccctgctcgcccagcaggatgacgtggccaccacgggcgagaccgtggcctcggccgcctacctgcatggcctggcggcggcgatcgcctccgaatccgagcaacaaggctggcaggagccggaactgatcggccgcgagcatcgccagcgcttcatgacgctcggccacccgattgtggccggcgacgtggcccacgccatccccgaagccatcgccgacgtcatcgcatgattccgtacgttggctcccctcagagaggggagccaacgtatgaaaccccctatactaaatcgcagaccccactcaacggccccaacaacacaaggagcatcatggccaactcccccatcaccgacgtgattttcgacttctgcggcgtgctgctggactggaacacccgcgcatgcctggaaggccgattccccgatgagatcgtggaacgcatctgcgccgacgacgacccctgcggcttcttccgctacgaggaccgcatggacaccggcgaggatttcgcggacatctacccggatgtggtacgcgaacaaggccaggaactcgccgacatcttcaagttctacatcggccactacgcggacgcgctgccccgcacgcttccgggcatggtcgagctgctggcggatttgaaggcccacggctacggcgtatggggtctgaccaactggtcgcatgagaccttccacctggccttcgagaagtacccgcgccttgaacagctgttgcagggcaccgtggtctccggcgtggagaagatgcataagccgaacgccgacatctacgagctggccctgacccgtttcggcctcacggccgagcgctgcgtgttcttcgacgacaccgccaagaacatcgtcggcgccaacgaggtcggcatccacggcatcctcttcgagaacgcgttgcaggcacgcgaatcgctcgcagaactcggcgtacgtctgtaagtcgccaaacgttgcatcgcggcagttgaagtctatggacccgtccttgacgacggtgaccggccgtgtggcgactatccctagcgatataaatagactttatgacactgctgcagctgaaatacatcgtcaaaatcgtcgagtgcggctcgatgaacgaggcctcccatgccctgtacgtctcccagccggccctgagctcgtcggtcaaggaattggagaacgagctgggcatcgagatcttcacccgctcctcgcagggcatcgccctgaccgtggacggcgcggaattcctgacctacgcccgccaagtgctcgaccaggccgacctgctcgaagagcgctataagcatgccaaaccgcgcaagcagctgtgccaggtctccacccagcactacatgttcgccgtcgaggcgttcgtggagatgatcaactccatcaagtccgacgaatacgagttcaccatccgcgagacccgcacgcgcggcatcatcaaccaggtcgccaacatgcagtccgaaatcggcatcatctacctgtccgattttaacaaggacgtgatcggcaagctcctgcgcgagaagcacctcgaattccacccgctcttccgcgcgccgctgcacgtgttcatctcgcgcaacaacccgctggccgccaagaaggtcatcaccatggaggacctgaaaccttatccgttcatccagtacgagcagggcgaggaaggctcgttctacttctatgaggaagcggtctggccggagtactcccccaagcagatcaacgtgaccgaccgcgccacgatcctgaacttcatcatcggcctcaacggctacacggtgtgcaccggcatcgacaacggcgacctcaacaacgagaagatcgtcaccgtgccgctcgacaccgacgaaacgatgttggtcggctggatcacgaacgagcgttccaagctctccaaggccgccgaaacctatctcgacaagctcaagtccgtagtctccgaccacggctacaagctcattgattaggagtaagtaaaacaggcatggtcagcagtgagatatactgcgattaagccaaccccgctggggaaatggaagtaagggccggctcctgagtatctcaggggccggcttttgcgctattgagactgactggcaaaaccagtttgatggcctccgactacttggccaagattaccgacgcggcggctgtcgcggcgaagcctttgagcacttcaatcatcacgtcgcgatcttcgacatcaatgttgcgggccgcggcgagcataatcggcagtgactgtgtcaaatgcgaagtgaggtcgccgaatgtgtcgtatccgccagcctcgaagatggcaaacaggttttcgatgaacttgcggcgatgctcgtcgtcgtattttgccatccatccgttgatcgtgcgtgccaggtattgcgcgctacttgtcagtccatcagcctgtacgaattggctatgatcgacttgccagtgcaatgcgaaatgctgcatgatgctggcaccgtcgctgctgaccaccgtatagccgtcttccacatgctcacgagtctcaaacagcatgccgatgatcgacgagcccggtaccgatttatgaatcttcgacgcaatgcgtacgtacccgtcctcatcgaagaacgcctcatcgaatccaggcccatcgtgcgaatatacgaccgtgatacgttcctgaatctcgctaggcacattggccgccgcatacaccgccagattgccgcctttggaatggccgccgaccataatcggcccggcccaatggccagccagctcggtcagataacgcgcggcggcctcctgcgaggcgaccgggcggcggaacgccatcatgaagtcctctttccacccgacgattgagctgtcggtaccgcgaaaagccacatagagcgtgccgttacccagttcgaacacgcaggccgagaactgcttggtggttgcagcatcgaattcgtccacgtatgcgcccacgcgtaggttcctccaacgtgggctctcgctcatcgcacgtaacagatcgacattcatcgaaggcgaccacaccttgccgaacatgtcgtcatagcattcggcacgcagcaaatcgtgaatcggaaccgtggcgatcatgccgtcggcggtctctgcattctcgtgatagcgcggcacgttatccggcatgcgagcataggccaactgggacaaagcgaggctatccgcctcggtgaacggcagttcggcgaaagtgtcgaaatgttgccgaatatcgtcggtgatgttccccatagcggccttccttgttcgaatgcaacgaacctacggtaattctacgccgagcgggttttcatcacaggcgagtcggtcccagagtttagaaccctatctcgctttcaagggagctgatttggccttctggagacatttatctccgtttcaagaggctgttcatccgtcatatcccgagtatgagcggcgtcaccccaacgtcattccgccattttcatgctgcttctacttgggcatcagcatctcggcggtcttcttcattaccttgcgacaacttgttcgctttgctgtccagatgatgctcgatgccgaagtaactgcatatccccacgagcgcaaacagccctatatcaactaaccagttcatagcacgctccttgccaaagcttttgccttaatatggtgctgctgttcatggaacgtaataaaaaaagcgggctcgcaagcccgcttttggtttttagattgaagacgatcaggcgccgtattcctcaaggtaggcggcggcgcgctgctggatgtcgtggctgagcagcggggtgccgtcggggttcttcatcttggcggcggcgtcgaagatctcgcgcacgttggcgatggagagcaccgggaagccgaattcggcttccacggccttcacggcggacatgtcggagtccttggtcttctccatgcggtccacggagagcacgagacccacgacctcgacgttcgcctcggccttgagtttggggatgacttcgcgcacggcggtgccggcggtcatcacgtcgtccacgagcagcaccttcatgccgtcggtcagcggggtgccaaccatccagccgccgtcgccgtggtccttcttctccttgcggtcgaaggtgtatccgacggtcatgttgtggccggcggtcagcgcgatcgcggtggacacggccagcggaatgcccttgtaggcggggccgaacacggtgtcgatgttgcggggaatcgtgttgtgcacgatggcctggctaatcttttcggcgtagaacgcgccgagcgcggcgatcttcttgccgtcgtcgaaggcgccggcgttgatgaagtacgggctcttgcggccggacttcagcgtgaagtcgccgaacttcagcgcgttggattccaacaggaattcagtgaagcgatgtgcgagtgtttctgccatgatgttccttacctccaagtctgtcctgcggccagtttagcagcgagttcgggacggctgtccaacaggtcgtcgagttcgcgggcgacgcgcagcggggccaccgggtcgaagagcgcggccgcacccacttcgacggcgttcgcgccggcgtacaggtattcgagcgccttctcgccgctgtcgatgccgccgaggccgatgatcggaatctccggcagtgcggtgcgcacccgatagacggctgccaggccgaccggcagcacggccgggccggatacgccgccggtgacgttggcgatgatcggcttgccggtgcgaatgttaatgcgcatgcctttgagcgtgttgatcatgctcaacgcgtcggcgccatgttccacggccgcgcgcgccggcacggtgatgtcggtgacgttcggcgtgagtttgacgatcatcggcttgtcggtcatcgggcgcagccggtccataagattggcgagggccaccgggtcggtgcccacgctcatgccgccggcggaaacgttcgggcagctgacgttgatttccagcatgtccgcgtcggagtcggcgagcttttccacgaccgccgcgtaatcgtcatcgcaatgtccggcgacattggagatgacgaacgcgcccgcggccttgagcttgggcaggtcctcggccaagtaatggtcgatgccgggattctgcaggcccacggcgttgatgttcgcggccggcgattcggcggtgcgcggcgagggattgccttcccacggtacgggcgaggcgcccttggtgcatacggcgccgagctggctgacgtcgtagaaccagcggacggcggcgtactggaaggtgccggaggcggtgccgaccggattcttccattccagaccggccaccttggtgtggtgcttccacacgtggggctcgtacaggttgatgtggttgtcgccgccctgcgcggactggttgtttgcgctcatcgtcacttcccccatccgagctgttcgcgggtgaacacgggtccgtcggagcagaccttgaggcggccgtccacggtgtcgatggtgcacagcacgcaggtgccatagccgcagcccatgcgctgttccatgctcagctgcgcggggatgccgcgttcggcggcccagtcggccacggccttcatcataggcagcggtccgcaggacagaatgatcggcttgcgatcgtaggccttcaggtcgtcgccttgttccagtttgttgagcaggtcgaccacgttgccttcggcgtcgtcgatgctccacgaccagtccgcgtaccgggagacgtattcctcggcgaagtggtcgttgcggtaaccgaatacggcggtggcaaaggaggcgtcgtgttcggcgagcttttgcgcggcgtagattagcgggggcacgccgagtccgccgccgacaagaatgtagttggcgtcttccttgaggttgaagccgcggccgagcgggccgagcacgtcgacggtgtcgccggcctgcagtcctgccaactgttcggtgccgtgtcccacgacggcgaagatcacgctgacttcgtcgccgtcgacttcgctgacgccgaacggacgcggcatgagcatgaagtcgtcgtgcgtgaacaggttgacgaactgggcgggcttggcatgggaggcgatgaacgggtcgcggaacgtcagtcgcatcacgcggtcggtcagttccgtaacctgcgtgatttcgacgttgtggcgcggcgggaagaatccggccgcagtcgcttccgtaaccacatcatgggtgggggtgaaagttgtcatttcattcctattcagcacatcaagctccccctatcaggggagcggtcaaccgcaggttgactgagaggtagttaaacacactcggctccggtttccagcccacactcacgtatagcccacagccggacaatctacctacctatatacggcaacccgcagattatcgcgcatgtcgagcgccgcctggcgcgcgctgctcgccacaaggtccagcgcctcgtcggcggtcatggattcggagtacttgccgctcttcttccatgcgccgataatgccgcgcgacgagttgacgatggcgccgctgccctgcttgtcgaacatgcctgccacgtccgcggccgtgccgccctgcgcaccgtagcccggcacgaggaagaacgtgtgcggcatacgttcacgcaacgccttgccttcctcggggtgggtggcgccgaccaccgcgcccacgcgggagtagccgtggctgccgatggtctcggcgccccatccttccacaagatcggccacgtgctcgtagaccttcgtgccgtcggccaggtcgagcatctgcagttcgctggaggacgggttggaggtgcgcacgagcacgaagatgtccttgtcggcttcggcggcggcctcgacgaacggggtgatgccgtcggtgccgagatacgggttgacggtcaccgcatcctcatgccacgggtcgaagtcgcccacgccgttcaggtggtgggcgtaggcggctgcggtggagccgatgtcgccacgcttgatgtcgccgagcacgtagaggccctgctgggccgcgtattcgcaggtcatcgtgtagatgtccacgccggcggggccgagcgcctcgtacatggcgatctgcggtttgacggcgggcacgatgtcggcgatggcgtcaatgatcgtgcggttgtattcgaagtaggcgacggccagctgcgcggattcgacttcctccggggattcgaccgagtcacgcacctcgtcggcaaagctcgccacgacctgcggcggcaccagcgcctcagtggggtcaaggcccacgacgctggggttctgagtgttgtcaatcgcttcgatcaggcgatccatgctgctccttgtgttatctacagacggctgaacatcagctgggagccgatgattgtggcgagggggcgtccggtgacctgccagccgccgaacggggtgttacgagccttggagtggaactgttcggggtccacggtccattcctcggcggcgttgagcaccacgaggtcgacattgtcggcgtcatccacgcggctcaagtcgagcagtcggttgacgccttcacgctgcggctgagcgtcgctctcccccgcaatcacgccatccggatcatccccggtgggcgcgggttcggcgtagtcctcgaccagcgcggctacgtcggttggcacatgccccatgagttcggcaggtccaacggacatgagctcgatcagacgctcatcggaaatgaagccgccgtcgacgagcaccttgtggcacacgccgtacgcgcattccagtccgatgatgccgttgggcgcctcaaggaagccgagttccttctctgccaacgtgtgcggcgcatggtcggtggccagcagatccacggtgccgtcggcgatggccgcgatggtggctttgcggtccgcttcggagcgcagtggcggattcatcttggcgagcgtgccgtacttgagcagcgcctcgtcgctcaacgccagatagtgcggcgcggtctcgcaggtaatcggcagtccttcggccttggccctgcgaatcgcctcgaacgagatggcagtgctcacatgctggaagtgcacgtggacaccggtgcggcgggccgcttcgatatcgcgggccacgatcttgagctcggtgtcttccggaatgccgggcacgccaagctcgcgggaaacggggccttcgttcacggcacctgtatcgtgatgctcgcaatgctcgatcaggtacaggtcggaggccttgacgttctccagcacctggtccaggatctccggcgtcacagcggaaccgtcgtcgctgattgcggtgatggggtgcgtgagcatggccggcgtcttggcgtcgtcctcgaatccgggcacgtacttgagccaatcggcaacgtcgcttgcctcatgaccggcgcgatccttggacgcgcacacgcacagatcgtaacgaaccggcaattgaacgtcatgcgcagtatcgtactgctgcaggaagtcgatgacgttgtcgaagccggcatccagaacctcttttgcaccggtcgcttccgggccagacacggtctgcccatccagtgccggcaacgtgttcggcatgatgagcacgttcgtgtatccgccggatgcggacgcacggcagccggagaccatcgattccttgtaggtctggccgggatcgcggaagtggacgtgtgggtcttcgaaaccgggggccacggtcaggccggtggcgtcgatgtcggcgccgtcagccacggcggaggtgtcggcgaagtaggcggcagcggtcccgggcaccacgaggtcgatgacctcgccggtgttccagaccttgatgttgcgtagggtgatgctcacagtttggcttcctcgtcgcagtagtcgcagcggtattcgagccgctcggagtgcacgaggtggaacatctgcttgatgccgggctcggcggtggtcacgcagcgcgggttcacgcaggaaatcacgccgacgatgtgctcgggcaggttcggctgcttcttttcgacgatcttgccgccgcgcaccacgtccacggtggcttggcgggccacgaagccgagcacgtcgaggtcgatgtccttgtcatcttcgattttgatgatgtccttggagccgtaacgcttggagtcggcgttcatgatgagcgcaagcttggttttggccgggtcgattttcaggtattcgagaaccttcagcgaggttccggccggcacatggtcgataatgatgccgttctgaatgctggtgacttccatcaggcctgaacctccttggggttgagcggttcgtatccgggcagttcgtcgcccaccacggtgctttcgagggccatgcgcacgagcatgccgttcttgacctgttcgaagtaggcggcacgcgggtcgtcgtccacgtccacggcgatttcgttgacgcgcggcagcgggtgaagcacggccatggacggcttggcgagctgcagcttctcttcgtcgagaatgtaggtgtcgcgcaggcgcaggtagtcgtcttcgttgaagaagcgttccttctgtacgcgggtcatgtacagcacgtcgaggtcgccgatcacggaggccaggtcgcgcacttccacgtaggagcagctgtcggtggcgttgatgcggtcgatcacgtactgcggggtcttgagctcgtccgggctgatgagcacgaagcgcacgttgccgaagcggcacagggtctcgatcagggagtgcacggtgcggccgaaggtcaaatcgccgcacagtcccacggtcaggtcggtgatgcggccgaagcgcgactgcagcgtggccaggtcggccagcgtctgcgtggggtgcatgtggccgccgtcgccggcgttgattaccggcacggatgcggcgcgggaggccaccagcgcggcaccctccttcgggtgacggatggcgaccacgtccacgtagttggacacggtcttcaacgtgtcggcgatggattcgcccttggtcacggaggccagctgcgcgccggcgaatccgatgaccttgccgccgagacgtagcattgcggtctcaaagctcaggcgcgtacgggtggagggctcgtagaacagcgtggccagcactcgcccatcgcaggtatgggcaatctctttgcggtgggaatcgatgtattcggccttatgcagcaggtcgagaatctggtttgtagacaggccgtccagcgttacgacgcttttgccgaccattggcgtttcttcagacaaggctcaccttttcgctcgtggttttcaggtggccacccttgcgtgacctaatctaacttacgccatttttcggacagccgcattcaccgagtgtccacctgaaaatccaacgaatatgctgccttatcgctgcgcgcggcgtcgatttcgttccagtcgcggtgcgatcacgtgcatacgcgggcgaggggcggtttgcggctgctgcgttgcggcggaggccgtggcggtggttgccgcagccgcctcgccttcggtcttcccatagaacaagcgctggcatacgtcacggcatttgcgcatcacggccagcaggtcgttctcgaaatgctggccgcggtgggcgccgtagccgaggtagacggcgatgccgcccagcgaatagatgtcatcaggcagaatatcggcctggttggcgcgcccgctccacagatagctgccgttgcgggccgcggtgcacaacgtccatgccttgcgcagctgaatcgcgtcgatagcgctgatgagcttcttggcttccagcacgtccaatgcctccagcgtgccgttgacgcgcagatctttgatatcgccggcgtgctggagctgcatgagttgcacggtccattccacgtcagacaagccgcccttgccgagcttcagatgccgttcacggcgcacgccgcgcggcagacgctcggcttccatgcgggccttgagcttgcggatgttctgcaattctgcttcagtcagttccgtggtcgggtagcgcagcggatcggcgatgttgatcaggaagtcccgcgccagttcagcgtcgccggccgcgtaccgggcgcgcagcagcgcctggcgctcccaggtcgaagcccaggattcgtagtattcctcgcaggaggcataggagcgcacgagcgggccgttcttgccttccgggcgcaggtccaggtcgagttcgatcttgggttccagcgtcgtcggtccttgcaggatgttgcgcaggtcttccacgaccttcttggcgaaggcgttggcttggccgtcgtcggcatcgtcggccggacggtagatgagaatggcatccgcatcggagctgaagttcacttcgcgcccgccgtaacggcccatggcgatgacggtgatgccggccggcgcggtttcgacgccgaactcggcgatctggtggcgcacggcccaggtcagggaggcatcgatgatcgcgtcatacacgtcggtcatggccttgagactgtcggagtcgctgatcacaccgctcatccaagacaggccgatgcgttcgatttcgtggcggcgcatggcgcgcatggaggtggcgaactcgttgatgttcgagccgaaacgttccagcgccgaaccggtctgcacgtccaaggcctcgcgcgtgcgggcctgcagattgtcgtcgtcgccaagccagctgatcgattcgaccgacttgttgagcgcgtcgcccaggaatcgtgagttggacaggatgtggcacaggcgctgggcggcggaggtggagtcgcgcaggaagccgaggtagccggattcggtgccgaagttctcctccagtttgcgccagttgagcaggcccatgtccgggttctggccctcgcccagccactgcaagacggcgggcagaatgatgcggttgattttggccgcgcgccccacgccggcggtgagcgcctgcacgtggcggatggcggcgtccgggtcgccgaaaccgatggattcgaatcgttcctgtgctgcctcgacgctcaggacgatctggtcgttctccatctgggcgttgaccggcagcatcgggcgatagtagatgtcgaggtgcaggtggcgtacttcgcggcgggtgtcgtcgtacttgtcgacgagttcttccgggtgcaggccgaatgcgcgggcgagtcggcgcagctcctggttctggttgagctcgtccacgtcgatgtcgcgcttcttttcgaggcctccgaccgaggcccggccgaggtccgggaacaggtgcgtgcgcttcagggaccagatctgctggcgatgttccatcacgcgctcgaagcggtagtcctgggacatgcgcacggcctgcttgcgcgagacatagccgccttcggacaggcgctgcagcgagtcgagcgtgttgctggtgcgcagcgattcgtcggtgcggccgtgtacgagctggagcatctgcacggtgaattccacatcgcgcagaccgccgcggccgagcttaatctcgcggtccttcaggggcgcgggaatcaaatcctccacgcgcttgcgcattttctggcagtcgtagacgaagttcttgcgcttggatgcgctccacacgaacggccgggtcatgtccatgtaggcctgaccgaggtcggggtcgccggccaccgggcgggccttgagcagcgcttggaactcccaattctcggcccactgctcgtaatagttcttgtgcgaggagagcacgcgcaccagcgcgccgtccttgccttccgggcgcaggccgccgtcgatctgccacagcggctgctcggccacgcccatgatggcggactggcagacgcgctgtaacatggtgcccatcttggtgcccacgcgaatcagcgtctgatggtccacatccttgtcggccggttcgaccacgtagatgaggtccacgtcggagacgtagttcagttcctgtgcgccgagtttgcccatgccgatgatggtgaagcgcacgtgctcgctgccctcggtttcgtggcgggcgatggccagcgcgccttcgagcgccgcgtccgcgaggtcggacagttcgcggctgatggtcggttggatggaggtcgggtcgtccgccacggcatcctgggcgatgatggcggccagttggttccggtagctggaacgcagggccgtggccgcttcggccagatccttggaggcgacgggcatggccggttcgtccgggtccgcgccgaccgccttgagcagacgtgcacggcgttgcgcgtgattgaacagatggctgttgcagttgtcgactgctgccgcctccacaagctgcggcttgaagcgcatgaacttgcccatcgcgtcggagacgccgagcaccgtgaccagacgcttcagggcgtcgttgtcggggatgacgtgttccagatcgcgctggctggattgcatcgcgttgacgatatccacgaaattgctcaatgccatatcggggtcgcaggcgtgggccagcgcgctcagcagttcggcgcatcgctcatcgggaatgtcgtccgccttgagctggtcgaacaaggcgcgggccttgtcgaggtcttgcagacctgccctgatgaggtccatggagctgggtttgaagatcgacgattccataagattccactatatacgctcatgccctccgaatggggcatgagccgggaaggagtcatcgggcgacgctgatgagctccgaggaatccatatcgtaatcggccatggcgtaggaacggatggcagggtcatcataggtgttcatgtaataggtgttggtcttggacgaatatccgctggtgaacagcgtgcgttcgaactggccgtcgcccatcttcgccatgccgtccaccatctgcacggagccgagggtgtggaacaggcgcgacacattggcggcttcatcgttctgctgcgggtaatgcgcgttggtgtaggccacacgaacgaagcgcgacggggaactcacgtcgcccgggatgccatgcatgcccacacccgcaccccaggcggtcaaggaggccttgccccatgaagtcggttcggccatctcgttgctgacgcacatgtagttgcgcaggttttccatatggaagtcgaacgtcggctgattggtcagcacatcgacgtcatcatgatgcacgtgcatgccatcggccatctgctcgacgacgatgctgcgcttgccgtcgccgatgaaccagtgcagcagagactcctgctgtcccggcacgatctgggagacgagcgtcacgttcctgagcgcctcctcgacctcgtcgacggagtcgaaattacgcgccacccacagcggaaattcgaacgtggcgacgttttccgtgccttcgaccggttcgtggacgaacgaggcgtagccggggaaattcaagccggcgatggccagaccatgttcattggcgcagtcgaaatacatcggcctatcggccatgaccacacccacgccgatcaccgcgttcggcttcgccttgccgcccgcaccaaacaccgtgtcatagtggtagccgcgcggagtaaccaggatggtctccccatatgagaaactccagtcgagattacgtccgaaataggtgttgccctcatcatcggagaaacggacaccagtgcacataacggactcccttccatcgctttggttggcttgcacgttcatgatacccatcggccgctgggagaactctgggtttcgccagcagattaacgtgcggcgcgacgcattgagatgcgccgcgccgcgatatgcgtcaaccttgcgtaccgcggaacaacggttccgcattgcgccagatacggcgcgtggtggcggggtggttcatcgaatacaggtggacgccgtccacgtcgtgggccacgaggtcggcgatctgctcggaagcgtagaggatgccggcggcacgcagggactggatgtcgtccccccacttgttcagcagggtgttgagcctgtccgggatgcgcgaggcgttgcgctcggccatgcgacgcacggacttggctccacgcaccggcatgatgcccgcctcgatcggcacggtgatgccggcggcgcgcgccttgtcgaggaagcggtagaagtcctcattgtcgtagaagagctgggaaatcaggtgagtgacgccggcatcaaccttgattttgaggttttcgatgtcctggtccagcgagtcagcctgatagtggccttccgggtagcaagcaccaaacaccttgaagtccggcttcacggagcggatgtatgacacgaggtcgctggcgtggttgaactcgccgaccagctgctcgccgtcgatgtagtcgccgcgcagcgcgagcacggcgctcacgccggcttcctcgaacatgtcgagagcctcatcgatcttggccttgtcggagtagagcgcggtcaggtgggcgactgcagggatgccgtattccttgctgatcgtgtgggcgatgcgcgcggtggcggtgcggtcggaatgggtgccgtgaccgtaggtcacggagatgaagtcggggttcagcccttcgagtccgtcgagggtgtcgtagatggtgccgacaggcgcgttgcgcttcgggggaaagacctcaagggtgaacatcggggaatgcatgctgatttccttacataaacccgagctccctcatccagagggagctcggtgatttccgctacttgtcgagcttggcgcgcacggccttggcggcggcgaccaggttctccaggctcggccaggtctcggcgttaccacgggtcttcagaccgcagtcagggttgatccacaccttcttgacgtccatcttgtcaaggatctcgtagatacgatcctcgatctccttctcggaaggaatacgcggggagtgaatgtcgtagacgcccgggccggcctcggtctcgaagtgcgcgtcatgaatggcgtcgagcaccaccagatcgccacgggaggcttcgaaggagatcacgtcggcatccatcgcgtcgatgtcgcggatgatgtcgttgaactcggagtagcacatgtgggtgtggatctgggtggtcggcttgacggcggagtgcaccagacggaaggccggaacggcccagtcgaggtacttgacgtgccagtcggacttgcgcagcggcagcttctcacgcagggcggcctcatcgatctggatgaccttgataccggcggcctcgagatcgagcacttcgtcgcggatggcgagggcgagctgcttggtctgctcctcgtgggtgatgtcctcgcgcggccaggaccagttgaggatggtcaccgggccggtgagcatgcccttcatcacatggtcggtcttggactgggcgtacgcggaccattccacggtaatcgggttggcgcgggaaacgtcgccccagacgatcgggggcttgacgcaacgggtgccgtaggactggacccaagcgttcttggtgaacaggaagccgttgaggttctggccgaaatattcgaccatgtcgttacgctcgaactcgccgtggaccagcacgtcgaggccgatctcctcctgcttcttgatgacggcgtcgatctgggctttgatgaactcgtcgtaggcttccttggtgacctcgcccttgcgcagcttggcacgctcggcgcgaatctccttggtctgggggaaggagccgatggtggtggtcggcagcagcggcaggccgagggcctcgcgctgcagggcctgacgctcctcgcgggcaggctgacgcacgtagtcggcgtcggacagcttgccgatgcgctcggcgacggccgggtcggcggccacgcgggtgccgtcgaacagagcctggttggcggcgagggcggcggatgccttcttctcgtcctcggtggcgtcggccagggcggcgacttccttgagctcgtcgagcttctggacggcgaacgcgaagtgcttgaggtcttcggccgggatgccggtctcgccttcggtgctgaacggcacgtgcagcagggaggatgcggtggagacggccacgttggcggtgacctgcttcagggcgtcgaccaggccgagggaggtggcgtagttgttgcgccagatgttgcggccgttgatcacgccggcgaagatggtggtgttggaggccacgccatacttggcgacggcttcgaggttctcctcgcgaccttcgttgaggtccaggccgatgccgtcgaagccgagcaggttgacggtctcgtacacgtcggcgatgtggccgaagtaggtgttgagcagcaccttgacattgcccttggcggacaggatcttggtgtacagggtcttgaagagttcaacgtcgcccggctccttgtcgagcacgaggtacggctcgtcgagctggacccatgcggcgccgagctcgttgaacttggcgagcacttcgacgtagacggcggccacggcgttgaccaggcccttgtcgagctcgagttcggtggcttccggggtacgggcgagcttcaggaacgtgtacgggccgatgaacacgggcttggtgtcgatgcccagcgccttggcctcgttgaactcgtcgaacggcttggtggagttgagcttgatctccgcggccgactcgacttcgggcaccagatagtggtagttggtggtgaaccacttcttcatcggcagggcggtcacgtcgcccttgtcgccctggtagccgcgggccatggcgaagagcgtgtcctcctggttgtcgaaggagagacgtgcgtaacgctgcggaatcacgttgagaaggatggcggtgtccagcatctgatcgtagtagctgaagtcgttgctgggaatgaggtcgatgccggcggcctgctgcagcttccagtgcttggcgcgcagttcggcggcggtggccttgacggcggcgaggtcgttggcacccttccagtagccttcgatgatcttcttcagttcgcggttctgcccgatgcgggggaagccggagacggaagtcagagtggacatgaatcctccaatgtatgcgttcgtaacccgacttagggtagcaaaacatccggattccggcccttataaatggccgcagagtgtcgttatagatggaatttatatccgctttagtcgaagtctttcacattgatgaccgcgagcagttcgccgctgtgcacctgccattcgtcgaacggtttgttcgatcccatgatcacgatggatgcgggcgaaagtcccaaattcagcaggtcgagtcgttcgccgtcggagtcggcggaggcgagccattgggcgctgatcgacacagtcggctcgtggcccacgatcatgaacacgcgattcttggccttgacgtgggcgagctcgtcgaacaccgcctgcactcccccgtcatacaggctgatgcggtagtcgacgattggcttgtcgccaaaggtcttgagcatgcggtccaacgtctggcgcgtgcgggtaacggacgagcaggagatttggtcgggcaccagtcccaacgactcgatgcccttgcccacggccttcgcctgtttcagacctttgtcggtgagctcgcgctccgagtcacccttgtcgccgaacggctcagccttggcatgcctcatgatgatgagaatatggtcgtatttcttcgccgctttggcgactttactcagcttgatgcccatccgtggctcccttcacgaaccgtctgcccggtgtggcggtgtggcggtgtggtattgcttccagtatagaggtgtgtgagcgttcacaaactcatcgtttggcggttattcgtgcgtattgccaagttctcccacctgacggtcgaggtcgcgcaacaccttacgtagtttgtggtcggagatgtcgcgcagttccagttcctcgatctgcgcttcacgctgttcgtcggtgagcgagtcgatgtcggtctgtgtgtccttggtcacgcgatcgcgctttctgagcgcctcgaacccggaggccatggcgcgcgagataacaaggaaaccggtatgaccgatcatctggtggtcggggcgtacggcgaggccctgggccttccatgtgcgttcgaacgattcctggatctgcggctcggtccagcagccggccgcgcgcagggcttcggccatgcggctcatctgcgtggtggtagttacgtaactgaccaacacgccgccgggggcaatcacgcggtatgcctgctcgagcctgttccacgggtcgagcatgtcgagcatgatgcggtcgaaccagtgttcgggcagttcggcggcaacggaatcgaagtcgccggttttgagatcccaccagctgggggcctcgccatagtacagcgtggcattggcttgggcgaccttggcgaattcggggcgcagctcgatcgtggtcaggtggccgcgctcgcccacggcgtccagcaggttcacgctcatcccaaccggaatcccgacacgtcaactccccaaggagttgacaaaaacataggaacgccccccctccgaggctggtcatcgcgattacgatgcaattacatcgcaaccgctatgaccagtttttttatgtgcactggtggggtgggtgttctcagcggtgttggggtgccatgcgctggccggttggcttcgctgaggggtgtgggtggtgtcatgttgccagcggttggctggttggcttcgctggaggttctctcagcgtcggtgatgtgccaaagagtggcgggctggcttcgctaaggagcgttaccgtcggtggagaaccagtgcgtgacctgctgccgacgctaagcgttcattaagcgtcgttagcggccaaaacttggacgtgtaacgatgctgggcggttttagcgtcgttgctgtgcctagttgtggtcctctgccgacgctgccagtgcagtagcgtcggcgttgggacaggtgttgggcctttgccgactctataagcgagggaaaatcattcgccggtgcctaagtgggtctattgccatgctgaatacatctgctgagtgtagctatgcgttcgaaggcgatttcgggacctttctcagtagcaaatatgcctaatgcgcggagttatacacttcaccgtgcacttatacacgccaaacgaagcagaaatcgactgctgacagtggacgacacgccagagacgatgtggataacccagagacggtggataacagctgcgcgatcagtggataacctgcaagaaagtgcggttatccaccgacggtagccactgttatgcacattccataccccttggaatcattgggttttccacttatccaccatctcgccatgtgggcttgcgagccaccgcacgaacgtcatacagtgtgcctcacggcgggcaacgtagcccgccgtccacatcacatgaaggggaaacaccatgagcaccgcaatcactactactgccgaaaatgccggtttgccagcaatgctggacaccaaagacgtagccgagatgttcaaacgctgcaatctcgccgtctatgccgaagcgagacgcatatattatcgcgaagtgaatctgaacccatgcaaaaagtatccgaagcaggtgctgcaaaggatcgaatggtggttctgggattggtttgcctatgactgcgccgtcagcggtattggactgaccggcaatgaatccgaagatttacgtatcgaattgcagtacggtccgggcgcaggtatctcgccattcctagccttggccgaattcatgtatgacaaggacgaacgtatcggcacacgcgagatacgtgattttcgcgaacttgatgacaccaatttcgcttcgatgttctggattcgcgatgccagcgcggtcaaaggtcgtctgacagttgaggacatcattcatggtggtgtctacgaggtggcggacgtacatgccgcctcgcaatacgatggtgcgcacggcggcatgatcgtcaatcgcatcgcacatgtgagaggcgtgtggcgatcctgttccatcccgatctatgaggcacgaaggcctgatgacccgcaaatcggtgattcgctggcccgttcattccgggaaaccggatataaaccggactttgccggtctggtgcggtttttctacgggagggccaaagacaccggtctcgactgggaagatgtggaagccgcgcgccaagccggtactttggacgcgctgatcaagaaggccagcaatcggtgaaggattcgcctaacgctgctgtccaagtcggcggccgcgatcacgaatgaagagtgacgcaaccaaacagaccgcgcacacaatggcgaccgtgcggaacgaagcccgcacgccaatggccgatgccgccgcttccggcactccggtgcgcatggccgccgcggtgtgcgtgttcatgatggtgaccagcagcacagccgcagacgtcatgatcgcgaagcccagtaaggcgagcggccggccaccgatacggtcatacatcttgcctgccaccgggttcaggatgcccatggcgatgccgctcggcatcatcaccagaccggacaccagtgcattaacgccaagatcattctgcaaatatgcccatcgcgtacaggaacagctggcgggtggtgaaggtctcgatgaggaacgcggtgatcgggatcatgatgccgttggtaagcatgaatccggtggtcagccattgcacggtgctgctgggcacgtcgaactcgtgcatcaacgtgggcagggcggagatcatcagcgtttggttgaggatggccacaaacgagccgatcatcagggtgatgaccatggcggtggtgttggcgggggtggtgctgttggagttggcggggtggtggagccggcctcagcggtggccggcgaggaattgcgtgacgtcaattatcaagtctcgtttccttggctgagttgtctttcttggcttgcccatactatctgtgccttgactgcattcgaaaaccattgcaatgactagcaacacgctgagacgcggcgtattaattcaatcatttgacaaacttagttcgttcgttttattattggtcctgcaatccgtaatatcgcctactgcaaaggagcgcccaaatgggtctgtgggatgttgacaagatcgagtacgtcggccgcgccaaaggaccgaaggaaaacttcgccttccattactacgatgccgacaaggtcgttgccggcaagaagatgaaggattggctgcgcttcggcgttgcttggtggcacaccttcaaccaggaactggttgatccgttcggcaccggcaccgcgcaccgcccgtactacaagtacaccgatccgatggaccaggctctggccaaggtcgactacgccttcgagctgtttcagaagctgggcgtcgagtacttctgcttccacgatcgtgacatcgcccccgaaggcgacaccctgcgcgagaccaacgccaacctcgacaaggtcgttgacaagatcgacgagaatatgaagtccaccggtgtcaagctgctgtggaacacctcctccctgttcaccaacccgcgcttcgtgtccggcgccgccacttctccgttcgccgacatctacgcctacgccggtggccagctcaagaagagcttggagatcggcaagcgcctgggcgccgagaactacgtgttctggggtggccgcgaaggctacgagaacctgtggaacaccgagatgaagcgcgagaccgaccacatcgccaagttcttccacatgtgcgcagattacgccaaggaaatcggctttgaggcccagttcctgatcgagccgaagccgaaggagccgacgctgcaccagtacgacttcgatgccgccaccgccatcgagttcctgcgcaaccacgacctgaccgacgtcttcaagctgaacttggaaggcaaccacgccaacctggccggccacacctaccagcacgagatccgcgtggcccgcgagtccggcttcctcggttccctcgacgccaaccagggcgacaagctcatcggctgggatatggatgagttcccgaccgatctgtacgagaccgtcgccgtcatgtgggaagtcctgcaggccggctccatcggacctcacggtggtctgaacttcgacgccaagccgcgccgtacctccttctacgaggaggacctgttccgctcccacatcgccggcatggatgcctacgccgccggcctgctggttgccgacaagatgaaccaggacggcttcatccagaatcttcaggccgagcgctacagctcctacgactccggcatcggcaaggacatcgacgagggcaacgtcaccttggccgacctcgaagcctacagcctcgacaagccgcagtccgagctcatcgccgccaccaagtccgatcacctcgagtccgtcaaggccaccatcaacaactacatcattgatgccctggctgaggtcgagtgaccatcggtctgaccgattgaattcgctccatcgggcgtgtacacatcaattatgatgccagtgcgcccgatgggctgattcgatagtttcgccatgtgcggtgttgtgttatgcccgcatggcgcctttccattccttctttctcctttctctccttccgctggcctgtccatcatgggcgtggacgccgcctgggtcaagaccatcaagggcctcgtcgtcatcgccgccgtcgcctacgacctgctcttcaagaaaaagaaaggctgagctaaacctggcctccgggcccgcccggtggccacggggatggatctgagttccattcctcctccgaaagggacgctgttgcacgcagcgtcccttttccgtttgtcgcgatggatggatcccggtgtacgttcttcgcgaaatcagccctgacttggggtgtatttcgacaatatgattcggcgatgtgcctcagcggatatgtatggccaatgaaaaacgggataccgatgtcgatatcccgctttcagcgaataggtaaggccagagcttacttcttcttggctttcttgacgcgcttgggagcgggagccgctttcttgggctcgaagaacggccacttgtgcaaagcccaggcatgcagcgcgggaatcttggcaacggcgaagccgatgaccagaccgattaccatggcccaggtctccagatcatggcctgcgaccagcaagccgatgaacactatggcaacgatgaagctcaccatctgcgaggcctttgactgcttggcggtcaccaggtcggccttcatgggaacgagccccagaaacaggccgcaaggcgcgcatatgacgcccagcaccacgctgatcacggttgacacggttgttacttccataatgttcctttgctgaagtgggatgattcgcttgattcgggcgaacgataacgatggttactggcgattagtggttggtgatgcatcggcatccgtggttgcgacgtcggtttcgacatcgtcatcggtgtcgtcctcggatccctcggcatctgcggtgtcggtatcggtgccgtcaggcgtatccgcggcgtcatcgttctccgcatcctccttgctgggttgacgccaccacaatatcaatgcgttggcggcgcagtagacggcggcaatgccgatgcataccaaaaagatgatgtttgaggtgctgatcatcgtgccatcggccattgcttctttggcggattgccatatccaaatcacgcatgcgacggcggtcagggcgtacagcatcatacgggagcggtcgttcatagaagaatctccagacttgttcaaacgacttgattatagccgtatttgtggattgcgtgggaaacgaaaaatgccgccatgtgtgcttcagcgaggagcgcggtataacagcggctcttcgcgatgcttgccatggcggcattcatcaggaatcgttattcagttgttatctcatggattgtgctggcagcgtatcagccgcgcgccttggcgtatgcctcgtacacggcttcggtgggctcgccggtctccacgccctcgatggtgagttgccaggtcagcggttcggcctcgccggacagcacccaggcggcctgacgggcggcgccgatggccacatattcgtcggtggccggacgggtcacgtccatgccgaggattgagggggccagcgtgcggatggccacggacttcgcgccaccgccaatgagcaggatgcggttgatctcggcacccagcgaacgaatcagctcgaggcagtcgcgctgggaacacagcaggccttcgacgaacgcacgagccagattctccttggtggtgttgtgcagggtcaggccagtcagcgaggcggtggcgtccggacggttcggcgtacgctcgccgtcgaagtacggcaccagggtgatgccgccggcacccggctcggccttaaaggccagttcggccagctcgtcgtagtccacgccaagggcggcgcgaccggcgttcagaatgcgcgaaccgttgatggtgcaggcaagcggcagataatgaccggtgcagtcggcaaagccagaaatcgctccggtcaggtcgtacaccgggttttcagcgatggccgcggccacgccggaggtgccgagcgatacggacacatcgcccacggccatgccgaggcccagcgaggccatggcattgtctccgccgccggggccgatgatgcagccgccttcaacgtccttgccggcaatggcggggtcggccttggcggcggctgcctcacgcgggcccagcacggtgggcagcacaatggcgtcggcgtgggccttggcggcttcctcgccctcggcaggggccagtaccatggcgatgagatcgcggcggtactcgtcatgcgcggcatcgtagtaaatggtgccggaagcgtcggaacggtcggtgaacagggcttcgagatgagcgtcctcgccctcggccaccgggccatagccggcgatacgccagctcagccaatcgtgcggcagacagacggcggcaatcttcttggcgttctcaggctcgttctcggccacccacgccaccttggtcagcgtgtaggaggcgacgggggaggatccgacggccttgacccagcgttgcttgccgcgggcggtcacgtcgtccggttcgtcgccctcggccggagctgcaccgagcttgtcgatcaaggcggcggcctgcggggcggaactggtgtcattccagagcatcgcatcgcgaatcacgttgccctgcttgtcgagaatgaccatgccatgctgctggccgccaaccgcgagggccgcgacatcgtcaagcccgccggcctgctcggcggccttggtgaaggcctcccaccagaattccgggttgaccgaggtgccatccgggtgcttggcctgcccgaaccgaacctgttcgccggtggcggcgtccgtgatgcggaccttcgttgattgggttgacgtatctacgccggcaaccagtactctcgtcatgcattcctcctcgatgagggtcgcgctcaaaagtttcggcgcgccatagccaataagttagacgattaaactatactgtatctcaacgttcgattgcaaacggaaacacgcgaaggtgcggtccgattcaatcgtttgacgcacaatatcatggtgtgatagacggatgtgagcgcctgtgcggcgctcgagactaggggtgcgaggaggtaggggccaatggcaaatctacgcaggatcaatcaggaggatctgcgcaaccataacctgtcggtgacgctcgacaccttattgcgtgcgcagaaaccgatgagtcgtgccgatctggccaaggagacgggcctgaccaaggccacgctctcgctgttggcctcgatgctcattgaaagcggcgtggtgcaggaaggcgagccggtcgtttccaccacatatgggcggcccagcacgccgctggagattcgcggcggatccatcgccggcatcggcctgcagatcaacaccgatggttacggttgcctggcactcgatctgaacggcgacactctcggccgggagtgggtgagtgaggatatgaccggcactgacccgtacgagatcttcgccaagctcgatgcgatgactttcccgttggaaagccggctcaaacgacgcggctgcaaggtggtgggagccgggtttgcgctgccgggcatcgtcaccgacgacatgtggctgttggtggcccgcaatctgggttgggaaaacgtcaacctcacccggttcaacgtggtgcgccggctggatgtggtggccggcaatgaggcgaagatggccgccatcgctcagattccggggtatgccaccgaacgtgcgcccttcctgaatgtggtggaccgcacggactcttttatttacctgtccaccgatatcggcatcggcggcgcgggggtgcgcgacggcgaagtggtgatgggctcgcacggattcgccggcgagatcggccatctgtccgtggcgatggatgggccgttgtgcagctgcgggcgtcacgggtgtcttgaggcgtttgcgggccgtcgcgctttggtcgaggctgccggcattgccgaggatggggatgccaccagcagcgaggccatcgatatgttcctccagcgttggcgagccggggattcggatgtggccaaagtggtcgatcaggccgccgatgcgctggtttccgccatcgcttccgccgtgaatctggtggatgtcgatacggtgctgttgggtggactgtggacgcacttcggcgacgagctggccaccgtgcttgaaggccggctgcgttcggaaattctgggatacccgaatgtgaagattcgcgtgtttgtgccgccggtggcgctgcatccctcgctatatggcgcggccgaaatgggcttgcgacggttcatcgagaacccgttggggtacatgggggagaagtagcgccgggagatgctgcttgttgctggcgggtgcatggtatgggtgcatggcgcgcgtgccggcattagcgggctcgtgctacactttggcaagttggctgttttacgcagcgaacgtggggccgtagctcagtcggttagagcatgcgactcataatcgcccggtccagggttcaagcccctgcggccccactcttttgcgtcgtctcctgcggcggcgcagcgcgtcttcacgtccagataggcgcgtacaatcccttaggttccggttcacgtcttgccataggggcatgacgacccgggtcccccgaatccataggagacgtaaaatgcagcagggtatccatcctgattatcaccccgttgaggtgacgtgctcgtgcggcaacaccttcgtgacccgcaccgctggcaaggaagatcacatgttcgttgacgtgtgctctcagtgccacccgttctacaccggcaagcagaagattcttgacaccggtggccgcgttgctcgcttcgagaagcgctacggcaagaagagcaagtagcatacttcacgccagtccgattcgatttggcatgctccggcatacccgatcgaggactggcgttttttgtattctttgacaagttttgttgcagcattgacctgcgcaatcgaataatcgaacagaacagcaccatacagaagaaagtgtgttatggcagacgaacagttcccggcggcggcaaccgcgcttgaggagtaccagtccatcgaagaacagatggcaagccccgaagtcgtgtccaacccggacaagctgcgcaagctgggtcgtcgtcacgccgaactgggtgccatcgtgggtgactacaaagcctggttgcaggtgaaggacgatctggcagccgctcaggagatggccggcgaggacgccgacttcgccgaggaagccaagcgtcttgaagacgaactgcccggtgtcgaggagaagctgcgcaccgcgctgatcccgcgtgacccggatgatgcgcgcgacaccatcatggagatcaaggccggcaccggcggcgaggaagccgcactgttcgccggcgacctgctgcgcatgtacacccgttacgccgagaagcgtggctggagcgtgaacgtgcagtccgagaacaccaccgagctcggcggcgtcaaggacgtgcagatcgccatccgcgccaagggcacgcccgctcccgaagacggcgtgtgggcttcgatgaagtacgagggcggcgtacaccgtgtgcagcgcatccccgtcaccgaatcgcagggccgtatccagacttccgctgccggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgccaaccggaatcacggtgaacatgcaggatgagaagtcgcagattcagaaccgtgccgccgcgttgcgcgtactgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaattacaaggcttacaaccttgacgccgtgctcgacggcgacctgcaggccgtcatcgattccgacatccaagccgacgaggccgaccgtctggccaatcagaaatgactttgccggatggctcccctctgtgaggggagctgtcagcgaagctgactgaggggagcctaatgtccgatcaacggagaccgccagtgcttattaccgacatcatcaaccaagcctcttcgcaattgtgcgaagcgggtattgagacgcctgagcatgatgccaagttgctccttgccgaggcggcaggcgttgaactgcgcgacgtcgacagggctctgcttatgggggaggaacttggtacaaccggacagcttgccgtcttccgtgccatgctcgaccgccgtgccaagcgcgagccgctgcaatacatcaccgggcatgctcctttccgctaccttgacctgaaggtcggtcccggagtgttcattcctcgtccggaaaccgaaaccgtggtgcaggccggccttgactggctgacaaaaaacggcatgatccatccttgtgtggtcgatttgtgcgccggctccggcgcgattgggctgtccgttgtcagcgaggtgcccggcagccaggtgtgggcggtggagctgtcgccgaacaccgccgaatggacgcgaaggaatctgtcggaaaccgcgaaaaagtacccatccattgcctcgaattaccatctggaaatcgcggatgccacgtccttcgccacattggcccaattggacggcaccgtcgatatcgtcatcaccaatcccccctacgtgccgcagaccgatattcccgagcagccggaagtgcgtgattgggatccggaattggctttgtatggcggctcgatggacggtacgttgattcccgagcgcattatcgagcgggcctgccgtcttctcaagcctgggggcgtgcttgtcatggaacatgacgtgacccagggggatcgtctcgtggcctttgccagggccaccggattcgctgccgcatcgaccggccaggactggacgggtcgcgaccgctacctgtttgcagtgtcctaagccccacgaatcccacatttccttgggattgtattctcgtttccgtaattgcgctgtctcataataagaacaatttattgcgggttcaaagccggtctggttataacagtccgcgacaaacatcggatgagagagacgtgaatgacggtcacaagccgtgtgatgtagttctgtggtatgcgaattatgtgagtggaacgtctcacgcgcacatcccgcgcgttggttgacagatgaacgatgttgaaatatcccaaggaagaaggaagaggatgaacgtgaagttctccactaagttcgttgcggccagcgcggccgctgttatggcgttgtccctcgcgggctgctccggcggcagcatggatgattcctccagctccagtgccaaggcctccggcgactccatcaccatcggcaccgtgaccaccaactccggtaccgccgccgcttacggcgaggccgaggtcaagggcttcgagctggcggtctccgagatcaacgccaagggcggcatcaacggcaagaaggtcaagctcgagtccatggacgacaagggcgacgccaccgaagcctccaacgcctacaacaagctcgccggcgacaacaacgtgctcgccgtggccggcccgaccatttccgccaccaccgcagccgtggccccgctggccgaccagtccaagctggtcaccatcgccccggccgccacctccgactccatcgaaaccggcaattacctgttccgcacctgcttcaaggactcctaccagggtgaggtggctgcacgcttcgccgccgagaacctgaaggtcaagaaggtggccgtgctctacggcaccggcgatccgtactcctccggcgtgggagaggccttcgccaaggccgccgaaaagctcggcctcgaagtggtggacaaggaaagctcctcctccgccgacgacaccgagtactccgcccagctgcagaagatccaggcttccggcgccgagctgctctacgctccgtactactactccgtggctggcccgtacatcatcccgcaggcccgctccgtgggtttcgagggctacgtgatgggacccgacggatacgatggcctcaagctcaccggtgacaagtcccagtacaacaagacctactacaccacccactactccgccgacgacaacaccaacaccaaggtgcaggacttcatcaagtcctacaagtccaagaacaacgccgagccgaacacgttcgccgctctgggctacgacaccatctacatgatcaagcaggccatcgagaaggctggcgagaacgccacccgtgaggatgtgcgcaacgccgtggccggcatgaccttcgacggtgtgaccggcaagttcaccatggacaagtccggctcgccgaccaagtccgtgaccgtgctggaaatgaaggacggcaagccggtgtacaacaccaccgtgcagcccaagtgaattccatgaattcccaccgcataatcacgatgtcctagcatgacttccgcatgaacaggagagcgaccggttttgccggtcctctccctttcgtgttttcatgggctcggatgcataaggacagccgtcgatatgcggatatcgccaggcgcgggcgtatcgcgccatcaatcgcaagacatacgaatatctctacgcgcgcagcggtagagaaccacaacattgatagaaagggggagctatgaccgatcagatcatcatgttcatcagccagctgttcaacggtctgaaaatcggcagcgtgtacgcgctggtggcattgggctacaccatggtctacggcatcatccgactgatcaactttgcccacggcgatttcatcatggtcggagcctacgtgctcatgctcaccattccggccatcgtggccatgggactgcccgcctgggtggcggtcattcccgccatcctggtatgcgtggccgtcggcgtgatcgtcgaaaaggccgcctataagccggtgcgtgaaaagggcaactccatgaccgccctgatcaccgccatcgccatgtcgttgctgctggagaacggctcacaggccatcttcggcgccgacttccagaccgtcccgaccatcttccacctgccgtccatcgcgttcggcaagctcaagctgccgggagacaccctgctgaccatcgtcatcggcctggtcatcatggtgggcctgcagctgttcgtcaaattcaccaggcagggcaaggccatgcgcgccgtctccgaagacaaggaggccgccgtgctcatgggtatcaacgtgaactccaccatcgccctgacattcgccatcggctccggtctggccgcggtcgcctcgctgatgtactgcgccgcctacccgcaggtctcgcctatgataggcgccatgctgggcctgaaggcgttcgtcgccgccgtgctcggcggcattggttccatcccgggcgccatgatcggtggtctggccatcggtctgatcgaaagcctgaccaaggcgtatatcggcaccatcacggcgggcatcatcacctcggcgttctccgacgccatcgtgttcgccatcctgatcatcgtgctgctcgtcaaaccgtccggcattatgggcaagaacgaaggggagaaggtctgatcagatgaagaagacaatgctttccaccaaacagtcctatcttgtgtgcttcatcggcatcctcgccgcgttcggcatcgtgatggcgctgtgcgaatccggcttggccgactcctacatcaagggcatcatgatgaccgcgtgcatcgccatcatcatgaccacctccctgaacctcaccatcggcgtgctcggccagctgacgctgggatgctgcggtttcgaggccatcggcgcctacgtggccgcactgacctccaaatacatggtcgccgccggcattgccatcgaccccaccgcccgcttcctgctcaccacgctgatcggcggcgtggtggcctgcgtgttcggcatcctgatcggcattcctgccctgcgactgcacggcgactacctggccatcatcacgctgggcttcggtgagatcatccgcgtgatcatccagaacctcaaggtagccggcggcatgggcctcgacaagggcgccgccggacaggcgctgatcggcatcgaacgcaccgccaacctgtacgtcgtgttctggatcatggtggtcaccgtggtcgtgctcttcatgttcggccgctcccgttacggccgtgcggtcaaggccatccgcgacgacgagatcgccgccggcgcctccggactcaacaccacgtacctcaaggtgctcgtcttcgcgatctccgcgttcttcgcgggcatcgccggcggtatcttcgcccagtacatcggctcgctcaaccccaccatggccggttggctcaactccatcaactacgtgatcatggtggtgttcggcggcatgggttcgctcaccggctcgatcgtctccgccatcggcctgaccatcctgcccgagctgctgcgcgccttcgccgactaccgtatgctcgcctactcggtggtgctggtgctcgtcatgatcttccgcccgcagggcatcttcggatcctgggagttctcactgccgcgtctggtcaaccgcatgctgttccgcggcgccgccggcaagggcgcgaaacccgcggccagcgccaagcagcatgaccagtccgacgacaagaccgtgaaggaggcctcacgatgagcgacgcaacccagcccatcctcaaagccgaacatctcggcatcaccttcggtggtctgaaagccgtgtccaacttcaacatgaccatcaacaagggcgaactcattggcctgatcggccccaacggcgccggcaagaccacggtgttcaacctgctgaccggcgtgtacaagcccaccgaaggcgagttctggctggacggaacccggatgaacggcaagaagacctatcaggtcgtgcgtgccggcatcgcccgaaccttccagaacatccgcctgttcaagcagctcaccgtcgaggaaaacgtgctcgtcgccttcgatgagtcgttcacctaccacatgggcagcgccatcttccgcaccccgggcttctggaagcaggagaacgagatgcacgagaaggccatcgacttgctgcgcatcttcaacctcgagggactggccaccacccaggcggccaacctgccgtacggccagcagcgcaagctcgagatcgcacgcgccctggccaccggcatgaaactgctgctgctcgacgagccggccgccggcatgaaccccaccgaaaccgaggatctgctgcactgtatcaacacgatccgcgaccgtttcggtatcgccatcctgctcatcgaacatgacatgagcctggtgatgagcgtatgccagcgcatccaggtgctggactatggccgcaccatcgcatccggcacgccggaggagatcgccaacaacccgcaggtcatctccgcctacttgggcagcgacaacaacgatgacgcggacggcgattccaccaccaaggcggaaccggagccaagcattgccaagacactgacggaaggagcgcgctgatgctggaaatcaaggatctatgcgtttcctatggcgcgatcgacgcggtcaagggcattagcctcaaggtgaacgacggcgagatcgtctccctgatcggagccaacggcgccggcaagaccaccaccctgcacaccatcaccggtctggtgcctgccaaatccggcagcattacctatgatggccacgatctgctcaaaacgcatgcgaacaagatcgtcacgctgggcatggcccatgtgccggaaggccgccacgtgttcacccgcatgagcgtgcaggagaacctagagatgggcgcgttcagtctcaaagaccagtccagtctgggtaaggatcttgagatggtgttcgactacttcccgcgtttgaaggaacgtcgccgccagctggccggcacgctttccggcggtgagcagcagatggtggccatgggccgcgccctgatgagccatccgaagaccatcctcatggatgagccgtcgatgggtctgtccccgctgctggtcaaggagatcttcgacatcatcgtcacgctgcgcaagcgtggcatcaccgtgctgctcgtggagcagaacgcgaagatggccctgtccatcgcggatcgcgcctacgtgctcgagaccggcaagatcaccatggagggcaaggcctccgacctgctgcacgacgagaaggtgcgcaaggcgtacctcggcgcgtgacgtctcacattactatgctcccgctggcgggagctacctcacgaagtgaggctgagggtggttatcggagatttccggcaaccaccctcagtcagctccgctgacagctcgccagcgggagcattcatatatcactgcgcgtaatactgtagcgcggaagcatccttatccgtaatctcgcgaatcggacgggccggattacccacggccacggtgtgcggcggaatatcgcgcgtcaccaccgagccggcaccgatcacgcaaccctcgccgatcgtcacgccgccgattaccgtcacattgccgccaaaccagcagttcgagccgatgacaatcggcttgccatactcgcagtcgtatgcggaaccatcaggtgcctgcctcacgttacgatcctgccaacgcaacggatgcatcggtggcagcagcgaaacgttcgggccgaacagcacgtcgtcgccaatcgtcaccgggcaacaatccagcacagtgaagttgaagttggcgaacacgcgctctccgatggtgatgttgcagccatagtcgaagaaaatcggccccatcacgtcaaggccggcaccgtggccgggcagcagctcatcgagaatcgcggcacgggcggcatgatcggtacgcgacgcggcgttgaagcgcgcgcacaggtcgccggccttctcgcgcagggcattcaattcagggtctaccgaattgtacagtttgccggcgagcatctcctcgcgctcgctggcgcgcggcatacgcagttcgacgggaggcatggtggtggattcagcattgatttcgctcattgaacactcctgtaatttcgcgaaagagcatggatggactcattgtatctacggtctgtgcgtgtggggcgaatcggaaaacggcagtacggcaaacgagcgatgatgaactatgcaagtcggggcgcaatggtgcaatggtagattgtgaatacacaagcgaacggaggtggcgtgagcgtggaaggcggaacaacgctgaaagtcacggatgaatcgctggcacaggcggcgcgtgtcatccgggatggtggattggtcgtcattccaacggatacggtatatggagtggcgtgcgatccgcgtaataaggccgctatcgaccgtatctaccggctcaagcgtcgcccgcgctataaggcgttgcaggtactgctcgcatccaccgaccagcttgatgagctcggtctcgacctgccgtccccgctgaatcgtttgtcggcggcgtttctgcctggcgcgttctcgccgattgccgtagcccggcccgactgcacgttggagactttggccgacaccgccgatggtcgccccggcacgcaaggcatccgcatccccaattcggcgctgtgcctcgcgattctcaaggcgactggcccgctggccgcgtccagcgccaaccgttccggcgacgaaagcgcgcagaccgtccaggaggcggttgacgcgttcggcagcgaagtcgacctgtatctggacggcggtcccacccaaggccatgtctccagcaccgtcgtcaaagccgatccgtacgcgcgcgacggcatcgagatcctgcgtgaaggcgtcatcgcccaaaacgtgattcgcaaggccctccacctcaacggcggtggactcggcgcatgagaatctacctactgattgccgccatcgccggtggcgtcacctggctggtgactccgctgattcgccacgtcgccatcgaaatcggtgcggttggcgaggtgcgtgcccgagacgtgcacaccattcccacgccgcgcatgggtggccttggcatgctgatcggttttgccgtggctaccgtattcgccagtcggctgccttttctctcgggattgttcaacggcaattaccagatgtgggtgattcttgccggcggcatcatgatcagtctgctgggcatggccgatgacctgtgggatctcgattggatgctgaaacttgccggtcagctgctgatttccgtattcgtggcttggggcggattgcagatcatctcactgcctttggacggttcgctgattaccgcctcgccgagtctgtccatggcgatcaccgcattcctgattgtcgcctcgattaacgcggtcaatttcgttgatggcctcgatggcctggcggccggtatcgtggcgattggtggcatagcgttcgccgcctattcgtatatcatcgcccggtcttccccgagttatgcttcgttggccacgctgatcgacgtgatgatggtgggtatctgcgtgggcttcctgctgcataattggcatcccgccaaactgtttatgggtgattccggttcgatgctgcttggctatctcatcacctgcgcttcgattgtgatgaccggacgtcttgacccggcctcgattcatgccagcatctatctgccggtgttcatgccaattctgctgccgattctggtgttgttcctgcctgtgctcgacatgtgtctggcgattgtgcggcgtttggccaaaggccagtcgcccatgcatccggaccgtatgcacctgcaccatcgcatgctgaagatcgggcattcggtgcgtggcgccgtgctgatcctgtggggatgggccgcgctgatcgcattcggttcgctgacgattctgttcttcaaagcgcagcatgtggccgtgggcatgcccatcgccgtggtggtgctgaccatagccacgatgtacccctatctgcggcatcgtattcccgagatccaagccgagaacctgacgctcgaatccgcacgcaagaacgcgcagcatgctacggttaagtcgcagtctgcagtaggggagagccgggattcgattggctctcaggcagcggattcgatgactgattcgcctgcggattcgcgggactcgcaggcgggtgaggtgcaggacccggcagcggataagtgagcgctcacaagcgtgtgtcgtgaaggtcagcgcgtgttcatatagtgtttgtatggctacaaacctcgatgaattgaacgcccaatcggcgtatgctccccttcctccgattttcgccaagctcggccttgcttatgatgatgtgttgctgctgccgaacgagacggatgtcattccctccgaagtggacaccagcactcatctgactcgcaagatcgtgatgaaggccccggtcctctccgctgccatggataccgtgaccgagtccgagatggccatcgccatggctcgtaacggtggtatcggtgtgctgcaccgcaatctgtccatcgacgaccaggccgctcaggtcgatgtggtcaagcgttccgagtccggtatgatcaccgacccgctgaccgtcaaccccgaggtcactctggccgacctcgacaagctgtgcggcaagttccacatctccggtctgccggttgtggacaaggaaaacaagctcgtcggcatcatcaccaaccgtgatatgcgcttcatcgcctccgaggattacgacaccctgaaggttaaggatgtcatgaccaaggagaacctggtcactggcccgtccaacatttccaaggacgacgctcaccgtctgctcgcccagcacaaggttgagaagctgccgctcgttgacgaggaaggccacctgaccggcctgatcaccgtcaaggacttcgtcaagaccgagcagtacccggacgccaccaaggatgagcagggtcgtctgcgcgtggccgccggcgtcggcttcctcggcgacgcctggcagcgtgcctccgctctgatggaggctggcgtggacgtgctcgtggtcgacaccgccaacggtgaggcccgtctggcactcgacatgatttcccgcctgaagcacgactccgccttcgacggcgtgcagatcatcggcggcaacgtcggcacccgctccggtgctcaggccatgattgaggctggcgcggacgccgtcaaggtcggtattggccccggctctatctgcaccacccgtatcgttgccggtgtcggtgtcccgcagctcaccgccgtgtacgaggctgcccaggcctgccgtgccgctggcgtgccctgcatcgccgacggtggcatccactactccggtgacatcgccaaggccctcgtggctggcgcttcctccgtgatgctcggcggcacgctcgctggctgtgaggaagccccgggcgagaaggtgctcctgcacggcaagcagtacaagctgtaccgtggcatgggctccctcggtgccatggccccgcgcggcaagaagtcctactccaaggaccgctacttccaggccgacgtgacctccagcgacaaggtcgtgccggaaggcgtggaaggcgaagtgccgtaccgcggaccgctgaacgccgtgctctaccagatgctcggtggcctgcaccagtccatgttctacatcggcgcccacaacatcgccgagatgccggagcgtggcaagttcatccgcatcaccgacgccggtctgcgcgaatcgcacccgcacgatatcgtgatgaccaccgaagccccgaactactccggcttccacaacaactgatcggttgatgcccgctagcttgcgctagttaggggttgattccttgtgaaaagggtctgcttatgcaggcccttttcgcgtatgtggctcgagatagcttgtatgcgctggggtatagtctgaactgttcttgtaataacgggtgacatgacgaaaagaggcttaccatggtcgacagccatgatgcagaaacttacagcgcaaaggattcgcgcctgatttggattgactgcgaaatgacgggcttggatatcttcggcggcgacgaactcgtcgaggtgtccgtagtgcccactgactttgacctgaatgtgctggacgagggcgtggattacgtcatcaagccgtccgagaaggccgtgaaccatatgaacgatttcgtgcgccagatgcacacccgttccggcctgatcaacgagtgggagaatggcctgagcctggccgaggccgagcagaaggtcaccgaatacgtgctgcgcttcacgccggaaggcgtgcgcccgctgctggccggcaacaccatcggctccgataagaagttcctcgaccattacatgccgaacctcatgagccacctgcattaccgcagcgtggatgtgagcacattcaaggagctcgcccgccgctggtacccggccgtgtacgagaaccgcccgccaaagaacggtggccatcgtgctctcgcagacatcatcgagtccttggacgagctgcgctactaccgtaaggcgtttatggctcccgcccccggcccggacgatgccgcatccaaggccatcgccgccgacatcgtagccaccagcatcctcaataagtagtccgccgtacttggctcccctccctgaggggagtctagagaggttgatatgcgccaaaccgaagccctggccattctgaacgccggcgcgaacgtgttcctgaccggtgcgcccggtgccggtaagacctatgtcttgaacgagttcatccgccaggctcgggccgacggcgccagtgtagcagtcaccgcgtccacaggcatcgcctccacgcatatcaacggccaaaccattcattcgtggagcggcgtcggcgtggccaccgccctgagcgccagcctgctcaaactcatcaaatcccggcgcaaacgcaagattcaggccacggacatcctcgtcattgacgaggtttccatgctgcacgcttggctgttcgacatggtcgaccaagtctgccgcgaagtacgccgtgatccacgcccgttcggtggcatccaggttgtcttgtccggcgacttcttccagctgccgccggtttcggtgtccgggcgcaaccgcgacctcatcgcccccacgcccgaattcatcgccagtcgcgaacggtatgcccgtgccggcttgaaccccgaaggcttcatcaccgaatcgctggtatggcccgaactcaacccggtgatctgctatctgaccgaacagcaccgtcaggataccggcgaactgctgaccgtgctcaccgacattcgcgaaggcgacgtgacccagtccgaccgtgacgtgctcgtcactcgtctgggcaaactgcccgagcccggccaggtcgccgtccacctgttcccggtgaaccggcaggccgacaatctcaacgacatgcgcctgaaccagatcatgcttgatccacacgagttccacgccgagacagcaggccctgccaacctggtcgaccgactcaaaaagaacatgttggcccccgagcgattgatactcaaggaaggcgcggctgtcatggccctgcgcaacgacaccgatcgccagtacgtcaacggctcgctcggcaccgtgcgtggcttcgcacaggagaacaagggcggctggccgatcgtggaattcgagaacggcaacatcgtcaccatgaaacaggccacatgggagatgatggacggcgacaccgtgctcgcctccgtcttccaggtgccgttgcgctgcgcgtggggcatcaccatccacaagtcgcaaggcatgacgcttgaccgtgcggtcatggacctgaagcgcaccttcgcgccaggcatgggatatgtggcgctgtcccgagtcgaatcgctgggcggcctctatttggccggcgtcaacgaacgcatgttcctcgtctcgcccgatgccgtggtgctcgacggcgacctgcgcgaagcctcggccgcggcctccgaccagttggccgatgaaggtgcaaacgcgttcaaacccgccgagccggacgaattcggtgccaatcccgacgatgacttcgcccaggacgcgttgttctgacatgattcatgttgtgtcgctaagaggatttgcgctatactgatacagctaattctcagtaagagtggacctgatagccactttgaatgctcagcaggcaactgctaggggcgagccatttggctcgccctgtttcgtacagttacaatgttcaagacaatgatgtgcattgtagctacggtgaaaggtgttttatgcgggggaagcgttaccggataggaattgacgtcggtttgaattctgtgggccttgccgcagtagaagtgtccgatgagaacagtccagtgcgtctgttgaatgcgcaaagcgtaatccacgatggtggtgtggatcctcagaagaataaggaagcgattacgcgaaagaatatgtcgggtgtcgctcgtcgcacgcggcgtatgaggcgtcggaagcgtgagcgcttgcacaagctcgatatgctcctcggcaaatttggataccccgttattgagccggagtccttggataagccctttgaagaatggcatgtaagggctgagctggctacacgatacatcgaagatgatgaacttcgccgtgagagtatttctatcgcattgagacatatggcaaggcatcgcggatggcgcaatccttatcgtcaggtggactcgctgatcagcgacaatccatattcgaagcaatatggcgaactgaaggaaaaagcgaaggcgtacaacgatgacgcaactgctgcggaagaagagagcactcccgcgcagttagtggtggcgatgttggatgctggatatgcggaagctcctcgactgcgttggcgtaccggttctaaaaaaccggatgcggaaggctatttgccggtacgtttgatgcaggaagataatgctaacgagctgaagcaaatattcagggtccagagagtgcccgcggatgagtggaagccgctgttccgtagtgtgttttatgcggtgtctcctaaaggttcggcagagcagcgtgtcggtcaggatcctctggctcctgaacaggctagggcattaaaggcttctttggcttttcaggagtatcgtatcgcgaatgtgattacgaacctaagaatcaaggatgcttccgcagaacttcgcaaacttactgttgatgagaagcaaagcatttatgaccaactcgtgtcaccttcttcggaagatatcacatggtctgatttatgcgatttcctcggcttcaagcggagccagttgaaaggcgtgggtagcttgaccgaggatggagaagaacgtatatccagccgtccgcctcgattgacttcagtccagcgtatttacgagtcggacaacaagattcgtaaaccgttggtggcctggtggaaatccgcgtctgacaatgagcatgaggcaatgattcgcctgctgtctaatacggtggatatcgataaggtgcgtgaagacgtggcgtatgcttctgcgattgaatttatcgatggattagatgatgatgcgttaaccaaacttgactccgttgatctcccctccggtcgtgctgcatacagtgttgaaactttgcaaaaactcactcgtcagatgctgactactgatgatgatttgcacgaagcacgtaaaacgctgttcaacgttacggatagttggcgtccgccggcagatccaattggggagcctctgggtaatccatcggtcgaccgtgtgctgaaaaacgtcaaccgatatctcatgaattgtcagcagcgctggggtaatcccgtctcagtgaacattgaacatgtgcgctcttcgttctcgtcggttgcctttgcccgcaaagacaagcgtgaatatgaaaagaacaatgagaagcgttcgatattccgcagctcgttgagtgaacagcttcgcgcggatgagcagatggaaaaagtgcgtgaatccgatttacggagattggaagccattcagcgtcaaaatggacagtgcctgtattgcggccgtacgattacattccgtacgtgcgaaatggatcatatcgttccccggaaaggcgtcggctctacgaacacgaggaccaatttcgctgcggtatgtgccgaatgcaatcgtatgaaatcgaacactccatttgcgatttgggcaaggagcgaggatgcccaaactcgaggggtaagccttgctgaagctaaaaagcgtgtgacaatgtttactttcaatcccaagtcatatgctcctcgggaagtgaaagcgttcaagcaagcggtaatcgcaaggcttcagcaaacggaagatgatgctgccatcgataatcgttccatcgaatcagtggcttggatggctgatgaactccaccgccgtatcgattggtatttcaatgcgaagcagtatgtgaattctgcttcaatcgatgatgctgaagccgagacaatgaaaaccacggtgtcggtgttccaaggccgtgtcacggcatctgcaagacgtgcagctggcattgaagggaagatacactttattggccagcaatcaaagactcgtctggatcgtcgtcatcatgcggtggacgcttccgttatcgcgatgatgaacacggctgctgcgcagacgttgatggaacgtgaatcattgagagaatcgcagcgtttgattggtctcatgccaggcgaacgttcatggaaggaatacccctatgagggcacttcacgctatgaatcgttccatctttggttggataatatggacgttttgcttgagctgcttaatgatgcgttggacaatgatcgaattgctgtcatgcaatcgcagcgttatgtccttggtaattccatagcacatgatgccacaattcatccgctcgaaaaagtgccgttgggctcggcgatgagcgcggatcttattcgacgtgcttctacaccggccttgtggtgtgctttgacgcgtttgccggattatgatgaaaaagagggtttgccggaagattcacatcgtgaaatacgagtgcatgatactcggtattccgctgacgatgagatgggattcttcgcgtcgcaagctgcgcagattgctgtgcaggaagggtctgcagatatcggttcggcgattcatcatgcccgcgtgtaccggtgctggaagacgaatgccaagggagttcgtaaatatttctatggcatgattcgcgtattccaaactgatctgctacgcgcttgccatgatgatttatttaccgtgccgttgcccccgcagtctatttcgatgcggtatggcgagcctagggtggtgcaggcgctgcaaagcggtaatgctcagtacttggggtcgttggttgtcggtgatgaaatcgagatggatttttccagtctcgatgttgatggtcagattggcgagtatttacaattcttctcgcagtttagtggagggaaccttgcatggaaacattgggttgttgatggattctttaaccagacgcagttgaggataagacctcgataccttgctgcggaaggattggcaaaagcgttttctgacgatgttgttccagatggggtccagaaaattgtgacaaaacaaggatggctacctccggttaatacagcaagtaagactgcggttcgtatcgtaagacgcaatgcttttggcgaaccgagattatcgtcggcacaccatatgccgtgctcatggcagtggaggcatgagtgaatcatgcaaaaccagtggcgtgtaatcgactgtaccgatcttgacggctccatctcctatgaacggggaaggatgcgagtcgtcaagaacgatacaggggagtgcgtggatgtgccacttgctcagattgcggtagtgctactgggattgcatgtgcgatgttcggctgcggtattacatgagatggcacggtatggcgtgtcagtcatgctctgcgattggcgtggtgttcctgacgctgcgctgcatgcatggactgacatgcctaccacagttaccacgcggcaattggcgcagtcgaacatgtctcttcctcgcaagaaaagtgcgtgggcgcgtattgtacagatgaagattcgtggacaagctgcttgcctcgattcatcaaaactcgaaggtggaggcttgctacgaggtattgcagcctctgttcgttcgggtgatccttccaattgcgaaggtcatgctgcacgtgaatattggaggcgaatgtttcctcaagatgagaaattcagaaggattccggggcagggttatggtcggaatgcgcagttggattatgcctatatggtgctgcgaggattcgcggttaaagcggtgatagcagcaggattaattccatctttaggcgtgaatcatcacgggcgcggcaattatttctgtcttgcagatgatctgttggaggtatataggccggcagtggattacagagtctcactgctgaatgatgaagactcgttgcaggagaaggcagtaaagaagcatttggtagatgctgtgaatcaacaattcaacggttccggtttgactataccgagctcattgaatgattttgcgcagcaatttggtttatattgcgaaggcaaaatcgacaggttgcaggttcccgaatatgtaggcgagtcatgaaacgcgatgaggacagtggcggcatgtggtgcttggtgatgtttgatttgccggtcaagacaaaacggcaacggcatgctgcaactgtctttagaaatatgttgctcgacatgggatatggaatggtgcagtattccgtatatgtgcggtatacgcctacgcaatcgggtaatagggcgacggtcaaaatgattaaagacaatctgccagctaatggcttagttagaattttgcatattagcgatcatcagtggtccacggcggcccgattttcttctggaaaacgtgagattgaggaagaaacgcctgactttctcacgcttttttgaacgtaggagagtctgaaaagattgaaaaatagcccttcttgataggctatcaagcttatcaagaagggtgaatgctaattcccagcccacgacaagtcaggccaacacgtatggcaagcttatcaagaagggtgaatgctaattcccagcaccgttcaagcaagtgcactcgatagtgcaagcttatcaagaagggtgaatgctaattcccagccaaaagcaaacgtcggattaacggcactacaagcttatcaagaagggtgaatgctaattcccagcgtgaggatgcagtcctgcagctcctcctcaagcttatcaagaagggtgaatgctaattcccagcttcaatcccgtgaggaagttctgcaagccaagcttatcaagaagggtgaatgctaattcccagcccatccatagtagtggtatcgaagaagtcaagcttatcaagaagggtgaatgctaattcccagctcgtcttcggtgcccactcgcgtgcagccaagcttatcaagaagggtgaatgctaattcccagcattcatgacgcttcgggtgctgttgccgtcaagcttatcaagaagggtgaatgctaattcccagcgtgagcttgtccgtgtctttcatcagtggcaagcttatcaagaagggtgaatgctaattcccagctgtttacgctcaaaaagcacattagattcaagcttatcaagaagggtgaatgctaattcccagcccgaggccggtagggttgcgtgtctggtcaagcttatcaagaagggtgaatgctaattcccagcgttgtaatcggtcataatagttttcaatcaagcttatcaagaagggtgaatgctaattcccagctctcccagttgctgccccttggcgtcgacaagcttatcaagaagggtgaatgctaattcccagccgtattcatcgtggcctcttcgcggtttcaagcttatcaagaagggtgaatgctaattcccagccgtacatgatggggtccttgaccttgtacaagcttatcaagaagggtgaatgctaattcccagcttggtggtgttgggcgtccggcgcagaacaagcttatcaagaagggtgaatgctaattcccagcacagtattattgtcctgatattcatgtccaagcttatcaagaagggtgaatgctaattcccagctcgtcgtccatctctgtacctcggtttctcaagcttatcaagaagggtgaatgctaattcccagctccatgaccgcgtccatcacctcatgcccaagcttatcaagaagggtgaatgctaattcccagccgttccccagtggggtgagtgtgatgcccaagcttatcaagaagggtgaatgctaattcccagcaccgattgcaacgcgaatatcccgggtatcaagcttatcaagaagggtgaatgctaattcccagccttgcctccgttctgcatccagctgtcgcaagcttatcaagaagggtgaatgctaattcccagcacgcggcgaagaatcttgttatcgcggctcaagcttatcaagaagggtgaatgctaattcccagcgtcgcacgtggcatggcatgttggcgaaccaagcttatcaagaagggtgaatgctaattcccagctgttgaggggaaccgtatcaaacctgattcaagcttatcaagaagggtgaatgctaattcccagctggtttccgtgccgcattggtcgcagtacaagcttatcaagaagggtgaatgctaattcccagctcatgggactgtgagcggcggcggcgtgacaagcttatcaagaagggtgaatgctaattcccagctagaagtgcagattccgttcctgcaaaccaagcttatcaagaagggtgaatgctaattcccagcaggacgtgcaacgcaagtatttcaagatcaagcttatcaagaagggtgaatgctaattcccagctcgtcgatgtgttccaagaggtttggtgcaagcttatcaagaagggtgaatgctaattcccagctattgttcgggtgcgatggtgatgatcacaagcttatcaagaagggtgaatgctaattttgaatgctggaatgcttgggttgatttggctgatttagctgtgatggccgctgcgggaatggcccttgcgcggttggcggcagaggttgcggcgcggattgcggcactgattgttgtgccaattgcgtctgcggtgaaaaatatggcgacggctgtgtctgactgtttatcggcggatgttccggctcaggttgtggctggaatggagaatattgcggttgcgccattgtatgcccctgccccttcattgccatttcattggcgcatggcgagggctgaaaaccaagatgatgaatcctgcatgagttatccgtgattcctgtgcgttggtacagcgcggaaggttgagcagccgacatatgcaggcttgtcggttcacgcgaatatctttaaacctatgacttccaatacccttcgtatgtcaaccatgttcctgcgcaccctgcgcgaggaccccgctgatgccgatgtcgattcagccaagctgctgcagcgcgccggctatatccgcaaggccgcacccggtatctggacctggctgccgctcggtctgcgcgtgctgaacaagatcgaggccatcatccgcgaggagatcaacggcatcggcgcccaggaagtgcacttcccggccctgctgccgcgcgaaccctacgaggccacccatcgctgggaggagtacggcgataacatcttccgtttgaaggatcgccacgaggccgattacctgctggcccccacccacgaggagatgttcacccttctggtcaaggacatgtactcctcttacaaggacctgcccgtcaccctgtaccagatccagaccaagtaccgcgacgagttccgtccgcgcgccggcctgatccgtggtcgtgaattcgtcatgaaggacgcctactccttcaccatcgatgaagaaggcatgcgcaaggcctactatgacgagcgcggcgcttacgagcgtatcttccagcgtcttgagctgaagtacgtacctgtgttcgccatgtccggcccgatgggcggctccgcatccgaggagttcctggctccgatgccgatcggcgaagataccttcgcgctggcaccttccggcaaggcatggaatgtggaggccctgagcactccggaactaccggaaatcgatgcttccaccactcccgccgcttccaaggaagccaccccggatgccaagaccatcgataacatgatcgagcgtgccaacgccgaccatccgcgtactgatggccgtgaatggcaggcttccgacatcctcaagaacgtggtgatcaccgtcaagcaccctgaggatgaagagcatgacgagccgtggcgtgaagtgattgtcgtcggcgtgcccggcgaccgtacggtggatatgaagcgactggaagcccagttcgcgcccgccgaacttgaggaagccactgaggaagacctgaagcagcaccccgaactggtgcccggttacatcggaccgatggtgcttggcccgcaggccgaggctgctggcgtgaagaacccggttcgctacctgatcgacgcgcacgtggtcaagggttccgcttggttcactggtgccgatgagaacgaggtcgactactacaacctggtgtacggccgtgacttcaaggtcgacggcgtggtggaagccgttgaggttcgccacggcgacatgagcccggatggttccggtccgttgagcttcgagcgtggtgtggaaatcggtcaggtgttccagctgggtctcaagtactccaaggcactggacctgaaggtgctcgaccagaacggcaaggccgtgccggtgtggatgggctgctatggcatcggtgtttcccgcgtgctggcctgcatcgccgaaacacaccacgacgaagccggcttggcttggccgtccgtgattgccccggctgccgtgcacgtggtggccaccggcaaggacgccgtggcgtttgaaggtgccgagaagctggtcgccgagcttgaagccaagggccttgaggttatttacgatgaccgcaagaaggtgtctccgggcgtcaagttcaaggatgccgagctgatcggcgtgccgctggtcgccgtggtcggccgcgattacgtcaacgacggcaccatcgaactgcgcgaccgcaacggcgaaaacaaggtcgccgtgcccgccgccgaagccgccgacgcgctcgccgagcgcttcgccgccctcagttgagtcccacttactcagcctcggcgttaatcgcatcaagcgccattctgcccagtcgcagaatggcgctttgctgtggataaccgaaacttatccacattcttaaaaattcaactgcgtcacagtatccacatttgccagttgcccttgtgcacttcaaacgtcatgcctcacagtggaggtaccgctggggcgtgcaagccggcaatgaagccggagacaggctccggcggtccacatccaaacaacaggccagcaggccgaggaaaggaccgatcatggcaaatcaacaagcagcagtgaccgtcaccggctttgtggccggtgatccgacactaggcggaactgagagtttccgcgtgctgacattccgtatgggcagcacgcgcagtcgactcaacccgactaccagacaatgggaggattacggaaccgcatgggtgggcgtcaaagcgttccgtgctttggccgtgaacgccgccagttcggttcgccgcggtgaccgcatcattgtggtcggctcactcatcaccgagcagtggaccaatgagcaaggcgaaccgcgcagtagaaccgttctcgaagccaccaacattgggcatgacctgaccttcggcaccacgtcgctgatcaagccacagcgtgccggtaatgggaacggaggcaatggtggcaacggtaacggcaatgccaacggtgccgtcgaaggtatggatggcggaaacgggcaacgagcatcgtcgccgtacgttaggccaacgcaatatggcgcgggcggtgccgcatccggtgtgggtattgacccgtatgcgacctcgtcggaatctggccccgtcgaatttggggtcacctccgattccggccaatcgccgtcgccatcaaccgagtccgcggccgtggccgatgccgtcatgtcgcaaccggacgccgacaccaatcaaccacagcccgtggcccaacaaacctacgtcgacggtttcgccgaatcttccaatcccagtgattccgaattctgagtgccaaccatacatcatgaaaaaccgctgtgttcgcctgtaatcgaggcaaacacagcggttttcctttacataacggggattaccaaatacgcacacggtccttgggtgcgagccacatggcgtcgccttcggtcacgccaaaggcatcgtagaagaggtccacgttgctggcgatgccgttggtgcggaattcggccggagaatgcgggtcgatctgcaggtactgttcggccagctcgtcgcggttcttggtgcgccagatggaggcgtagctcaggaagaagcgctgcaggccggtgaatccgtccatttcgggggcggtatcgagcagtgccttgatggcggcgggggagccgtcttctttggcgtcggacttacctgccgccttgccgagcgcgaatgcatacgccttgagcgcgatgttcacgccgcccaaatcgccgatattctcgccgatggtcagcgcgccgttcacgtgcggtgccttatcaggctcgtcagcgtacttctcggccagctgcagcggcacaaagctgttgtactgggcgatcaatgcgccggtacgggcctcgaagttcttgcgatcctcgtcggtccaccagttgttgagcttgccgtcgccgtcgtactgcgaaccctgatcgtcgaagccatggccgatctcgtggccgatcactgcgccgatgccgccataattcgccgcatcctcggccttcgggtcgaagaacgggggctgcagaatcgcggccgggaacacgatgacgttcatgctcggctcgtagtaggcgttcaccgtctgcggattcatcagccattcgtccttgtcgaccgacttgccgaccttggccagctgatagccggtctcgtacaggttcgcggccttggcgttctcggcgggcagcgcatccgcggaaacactcagcgccgaataatcgcgccagtggttggtgtagccgatcttcggcgtgaacttggagatcttctccagagccttggccttggtgtcctcgcccagccaatcggaattggtgatggacacgcggtaggcgtcaatcagattggcgaccagctcttccatgcggcgcttcgagctttcggggaagtgcaggcgcacgtattcgcggcccacatcttcaccacaaatgccgttgaccaggctcaccgcgcgcttccaacgatcgcgctgcttcttggcaccggagagcaccttgccgtagaagtcaaagttggtggtgtcgaagtcgcgagacagggaggaggcgaagcccagaatcatgtgaacacgggcccacagcttaaggtcggccagatcggcctcggcccagaacgcatcaagaccagtgaggaagctcggctcgtgcacaatgacgcgcgcgaacacagacttgaaatcaatcggctgagccttggcggcttcggtggcgtcataagcggtctgccaagcgtcgatccaagaaccgagatcgaagtttttcagcgtggcggccagatcggcgtaatcggtggggttgtaggtcttcaccgagtcgcgcgtggccacattgtcccaatggttggcggcgatcttggtttccacggcaaggaagtggcgggccatgccgagcgcggcttcgctgggaaccgtggcgggagcgttgctctcgtcatcgccggtgttggacggcagctcatcgccaccgttggactcggcggcgggcgcgtatccggcgttcaccagctgggtggcgaccatcgccacgtatgcttcgcgcacgggagcgtagtgatcctcgcgatagtaggcttcatccggcagacaaaggccggcctgctcaaggtgggcgatgttgcggtccgggtcgcccgggtcgccgtaaacggccaagccgaacagatcggggccgccggctgggttgatcgtgccgagcacgcgcgtgagtgcggccttgtcgatggcggaatcgatgaggtcaagctcgtcgcggattgggtcaagcccggcggcctctatggcgtcggtgttgaggaatgagcggtacagggcctcagacttgacagccgggcagtcgtcggcgtcgaggatgtcgcgtacttggttttcggcgtcttcggcaagcttgtcgaaggagccgtagcgcgaacgatcgtcgggcaatcggtaggtgtcgatccatgggccattcacgtagcggaacaggtcgttggtcggcttgatgacggaggagaacgatgccgggtcgatgcccgacgtcagcgtttcggtttcgttggtcatggccctaagcctaatcgcggcgggggagaagcgttgatggtgcagatattgcgttatgggcattgcgctgtcagtgaactagacagattgcctaattgtggtgatggttcaaattagacaacttgtctatcatagtatgtggaatctgaacatggaccttgagctaaggagttacgatgagcaatccgaacgaggaccagtggaatggccagacgggccagcccaaccagagccagccgaaccagccgaatccggcgggtcaaccgggccaaccgcagtatggtgcgtatgacagcaatcatggcggccaatatcctccgcaaggtgcgccgggagcgcaagacactcagaatcagcatgcgcagaacggccagccacaaggcgaaccgaaccagaacccgtactacggcccgtacgcctacaatccgaactatggcccgaacggccagccggcatgggggccggacggtcggcggtatcaggcggacggccaatcgaatagccaagcggacgggcagccgaatggtccatggggcgatcaaagtcaacccggctggcagcagaccaactggtatgtcggcaatttcagtccattccgcctgatcgaggaatggctgccggaaaaagccaagaccaagattcgcatcatttacggcgtggtgggcgtggccgccatcgccttgggcgctgcgctgttgctggtgccgaacaagacgctggctttggccgcattgttgctcggcgtgtatttcgtgatttccggcgtggtgcgcatcgtcagcgctctcgtggagccgggtctgccgggcggctggcgtgtgctggacgtgttcgtcggcattctgctgacctttggcggcgtggtggttgtgcgcaactacggcatgaccggtcagacgctggcattactcattactttgatggtcggtttcggatggattatggaaggcgtgctgtcgctggttgaatcgtggcgtatcccgcattccggctgggccatcgcctatgccatcatctcgattatcgccggcttcgtggtgctgatgagcccgctgagctccgccgtattcatgattatcttcggcggatgcgccatggtggtgatggggattacttcagtgattcgcgcgttcactttcggcaagcgtcgcaagtaatctcacgcttcatgcaaccagtccccagacaatcaatccaaagcgcccgtgcaggctatgtgctgccgggcgctttttctcggccttggctattaatgggctgcgagtggatttcaggtaggcttctggcggttgacctcgggctggtctagagttgagaacaagtctcaacaaggtagaaagaatctcatgatcgaactgaaaacccctcgtgaaatcgaggaaatgaagccggctggtcgttttgtcggcggcattctgaaggaactgcaggagaccaccaaagttggtaccaacctgctcgaaatcgacgagttcgtccacaagaagatcgtggaccgcaagggcgccgaatcctgctatgttgactacgctcctgacttcggcaccggcccgttcgcccactacatctgcacctccgtcaacgacgccgtgctgcacggcgtgccgtacgactacagcctgaaggacggcgacctcgtctccctcgatctcgccatctctgtggacggctgggtggccgattccgccgtcagcttcgtggtcggcaaagacccggaccccgaagacctgcgcatcatcaagtgcactgaggaagcgctcgccgccgccatcgacgtggccaagcccggcaaccgtctcggcgacatctccaacaccatcggcgacgtcgcgcgcgaatacggctacccgatcaacctcgagttcggcggtcacggcgtgggccacatcatgcacggcgacccgcacgtgccgaacgacggccgcgcccaccacggctacaagctgcgcgaaggcctggtcatcgccatcgaaccgtggttcctcaagaccaccgacgagatcttccaggatccgaaggacggctggaccctgcgtgcctccgacggctcgcgcggcgcccactccgagcacaccatcgccatcaccgagaacggcccgatcgtcttcaccgatcgcaccaacctctgatcggcgtttggcgtatggtaggtgcctgattggcctgtgatgggcgatcagcgtctcattagccgtccgtctgttcgcggttttcccgcgaattcgagacgtaacaagccgaagtgcgtttgctttgatagcatgagcgcacttcggctttcgtgtatcgaccggcattcgccagcggtaacacagaagacatagagtaccgaacactagtgttcgcgaacgcgtgaacgttaatgtttggggtaagtggttcatgaagaggaaggtgcgcgaatggcaacggcacaacttgatgtcgattcgaacaagttcaacctgcccgtggttaaggctagtgcagggccggatggcatcgtcgtttccaaactgcgcaacgatggctgggtaacgcttgatcccggattcctcaccaccgcgcagtgcgaatcgaaaatcacctacatcgacggcaagcattcgattttgcgctactgcggttaccccatcgagcaactgtgcgagaactccgattttctggaggtggcgtggctgctgcgccacggcgagctgccgagcagggctgagtatgagcagttctgtgcggacatcaatcacaagacgatggttggcgaagacttccgtaccttcatgggttcgttcccgcgctccgctcacccgatgagcgtgcttgcctccgccatcaatgcgctggccacgttctacccggacaccaccgatatttctgacaacgaccagcttgatgaggccgccaagatcatcatggccaaggcccgtacgattgtgtcgtacatcttccgccgtcgtcgcgatgagccgatgctgtaccccgattacgcgcgcggctatgtggacgacttcctgcgcatgtgcttcgctgtgccgtacgagccgtttgaatccgacccgctgtatgtgcatgctttgggtcgtttgttgattattcatgccgaccatgagcagaactgctcgacctcggtggtgcgtatcgccggttccgcccacgccaacctgtattcggcggtggccgctggcgtcaatgcgctgtccggtccgttgcatggtggtgcgaatgaggccgtactgcgccaattgaaggcgattcgtgattccggcaagtctgtggccgagttcgtgcgtgatgccaaggagaatggccagaagatttccggccttggccaccgtgtatacaagtcgtatgatccgcgcgcggcgattgccaggaagtatctggaaaagatcatggagcgcgaagatacgcagaagctgccgtctgacgagcgcgcgctgttcgccgtggccaccgagcttgaagatattgcgctgaatgacgaatatttcgtatcgcgcaacctgtatccgaacgtcgacttctacacgggcttgatttatcgggcgatcggcttcgatccggccatgttcaccacgctgttcgcgctgggccgcattcccggttggattgcgcagtaccgtgagatgttggccgacccgaataccaagatcggccgcccacgccaggtctacaccggtccggtcgagcgcgatttcgtgccgatggacgagcggtgattgttggtttgagaaagcgcttcgctggagattccagtgaggcgctttctatatgtacagcgcaaaccagctatgctgcgacggctgcataagaactagcagggctagttctgaaattgaaataatgtgtgcggtatcgaggcgcaccgagggaaggcgtacgaaggtacgtcgaccgaggggcaacgaagataacgctccattatttcaatttcagttcttgtgcagcttggcgttgagctcaattcccaccttgcggtagcgggcttcgatgcggccgttcaccgagttgcggataaacagaatgttgtctttgccggagagctcagcacccttgaccacttccagcggttcgccagcggcggccttggccttgtcccagatggtgatcttagtgccggcggtgatgtacagaccggcttcgacggtgcagttatcgcccagagagatgccgataccggcgttggcgccgagcagcgagtgctcgccgatggaattgcgcagcttgccgccaccggacaaggtgcccatgatggaggcaccgccgccgatgtcggaaccgtcacccacgaccacgccttgcgaaacacggccttcgaccatggagacgccgagcgtgccggcattgaagttcacgaatccggcgtgcatcacggtggtgccggaagacaagtaagcgccgaggcgcacgcggtcggcgtcgccgaggcgcacgccggtgggcactacgtaatcgatcatgcgcgggaacttatccacaccgaacacgttgacagtggcggcaggagctgcggcaggcagtccggcctgggaggcgaaagcgagagcggcttcggtggaggcgcgttcgacgtcggccttgcgcagcgtgaagtcttcaacggcgaaggggccgtagttggtccacaccacattggcgagctgggcgaagatgccgtcgaggttcagcgtgttcggcttggccatgcgcatgctcatcaaatggagcttcaggtaagcgtccgcggcattactgatcggctcgtccaactggctgacgacgaataccggcacgcggcgaatgccacgggcgtcggcctcatcgtgagccaaagtaccgaaattgtggttcgggcgatcggactcggccggtgcctcaccgagattcagttcggggtaccagacgtccagggtggtgccggcggcgtctacgctggccagaccccagccccatgcggtacgctcttcgctcatagttgctccttattgttgtacgcgctagtgcacgcttgtggacgcgcgatgcgattaatgattcccaccttagccttatgtgcgcctgggtgagggacgatgcccgcgaaatggcttgaaatcgtatttcccggtaaaaaattaccgagtgtgattggcgatgggatgataggttctccggtgaaattcgctggtgaacaactcgacaaggaggtgtgcgatgtgatgttgcatcattcgggagcataggctgtggccatgcgacgcccggcatcatagagtttgcgcttgagcgaatcgggctcaagaatcactacgcggccatcccaggaatactgcaatgcccaccagaacacagcgcgttcgggagcatcgacgatgacttcgaactgtgtgccgtccggtgaatgtttgatttgagggtcgtcgaaccattcgaacacgttgttgagcatggattcgtctcgtacggccatgcggatgcgaatcggggcatcggctacggggtatggacggtggcgcatgaagttcactgcgtcaaaatcagctggtgctggtttttccagtggcactgtgccgttcctgcctttggcgctgacgttggcgattcggttgaccacgaaaatgcggaggttgtcttcgccatgcaggtggcagatgaggtaatagcgtccgttcttgtacaccatctggtaagggtcggcggtgtaggtaattcggcctgcacccgtacggcttttatgcggtatcaaggtgccatccggtccgtaatcacggtattggaaggttacgccgtggccttcttcgatggcttgattcagctggtcgatagtggataggaactcaccgttgatatatcagggtcgtcgccggggacggggcccggtggatcgactcatgcgtgcatgagtggtgcccgaacgccgaacgcgcgcccgacgggttccacatcgtcagttggacgagcggcgcgcccgacaacccacgaaaacagcagaagcctcttttttgtgctatcccgtaaaactgcgggacggcagctcattttcgccgtttgagccgtgccgtcccacatcaccctttgcggaccgtgacaccataacaccgagaatggcggaatttcaacgattccgtaattcgtactgcgggacgccacgctagtcaatcgattgacactcgtgccatcccgcaacagtgtgggatacgacgtcaaaatccgcgaaaatcgcgtgccgtcccgcgcgtacggcaccgcacgaatacatgctgatgaaccgcatagaaaatggctccccgtgtggggagccatgagctagttactaactagcgatgcgtcacttctcgttctggccgtggcacatcttgtacttgcggccggaaccgcacgggcacggggcgttcttgccagtgccagggaaggtgcggccgtcggcccacggcgtcttgagctcttcgctcttcggacgcttggaaaccgggaccttgccttcggcgtggctgatcggagccggtccggcaacaggcagcgtggactcgccggccccggaggcggctgcggattcggcgatcgcctgcttggcgtccgtatcctcgtcctcttcctcgacttcgccctcggcggcctcgaccacggattcgccgttctcgtcggggccggaggccacggcgatggtgtcggcgctttcggcggtctcctcgacctcgtcaacggcctcgtcggtggtggcgacctgcttgatgtcgatgtggaacagcagctggacggtctcctccttaatggcctcgatcatggagttgtacatctggtagccttcgcgctggtattcgaccagcgggtcgcgctggcccatgccacgcaggccgatgccgtccttgaggtaatccatctcgtaaaggtgctcgcgccacttgcggtcgagcacggcgagcaccacgcggcgttcgagatcacgcaagccggtctcgccgatggtctcctccatttcgccgtactgctgcctggcgtcctcgacgatcaggtcgcgcacggcctcgacggccttcgcacccttgaggccgccgacgatcttcctgacctcgtcttcgtcgaccttggtggggatcacggtgttgagcgccttgaacaggccctcccaatcccagtccttcggtttctcggatcccttgttggcacccttgatgtaggactcgacggtgtcggaaatgaaacgcaggatgtccttgtggatgtcttcgcccttgagcacggcctgacgctcggagtagatgacggtacgctgcttgttcatcacgtcgtcgtacttcagcacgttcttacgaatctcgtagttgcgggattcgacggccttctgtgcggtgcgcacgcccttggtcacggacttggcctcgatcggctggccttcctccatgcccttggccatgacctgggccaccagctgggtgttgaacagacgcatcagatcgtcttccagcgacaggtagaagcgggactcgcctggatcgccctgacggccggaacgaccgcgcagctggttgtcgattcgacgggactcgtggcgctcggtgccgagcacgtacaggccgcccagctccttgacctcctcatgctcgtccttgacctgggccttgatctcgttcagggtgcccggccaacgcttctcgtactcttccggggtgtcttccggagagtagccttcggacttgagcttggcgtcggcaaggaactcgacgttgccgccgagcatgatgtcggtaccacggccggccatgttggtggccacggtgacggcgcccttgcggccggcgacggcgaccacggcggcttccttctcatgctgcttggcgttcaggacctgatgagggatcttggccacgtcgagcagagtggagaccacttcggagctttccacggaagcggtaccgagcagcaccggctgtcccttggcgtgacgcttggccacgtccttgacgatggcggccagcttctccttcttggtgcggtagatgaggtcgtcctggtccttgcggatcatcggcttgttggtcttgatcggcagcacgcccagcttgtaggtgttcatgaactcggcggcctcggtttcggccgtaccggtcatgcccgcgagcttgtcgtacatacggaagtagttctgcagggtgatggtggcgaaggtctggttctcggccttgacctccacgccttccttggcttcgatggcctgatgcaggccctcgttgtagcggcggcccggaaggatacggccggtgtgctcgtcgacgatgagcacctcgccctgggtgacgacgtagtccttgtcacgcaggaacagttccttggccttgatggcgttgttgaggtagccgatcagggcggtgttggccggctcatacaggttgtcgatgccgaggaagtcctcgaccttggtgatgcccgggtccaggatgccgacgaccttcttcttctcgtcgacgtcgtagtcctcgtcgcgggtgagcttcagcaccagcttggcgaactgacggtaccagcgggtcacgtcgccttcggccgggccggagatgataagcggggtacgggcctcatcgatgaggatggaatcgacctcatcgacgatggcgtagtggtggccgcgttgcacgaggtcggccttctcccaggccatgttgtcacgcaggtagtcgaagccgaactcgttgttggtgccgtaggtgatgtcggcgttgtactgcttgcggcgctccggcggcttctgctcggtgatgatgcagccgacgttcatgccgaggaagcggtagatacggcccatcagctcgctctggtagctggcgaggtagtcgttgacggtgaccacgtgcacgcccttgccttcgagagcgttcagataggtgggcagggtggcgaccagggtcttgccttcaccggtcttcatttcggcgatgttgccccagtgcagggcagcaccgcccatgagctgcacgtcgaagtgacgctggccaagggtgcgcttggagacctcgcgcacggtggcgaacgcctcgggcatgatctcgtccagactcttgccgttttcgatttcctgcttgaacttcggggtttgggccttcaggtcctcgtcggagagggcggagatctcgtcctccagggcgttcacggccttggccacgttctccagcttcttgagctggtggccttcacccattcgcagggctttgtcaataatatcgaccactgggttctcccttgactgataagtggtggtgtccgcgtaccagaatagcgcctcgcaccgtcagcaatcgaatttttcgacctttttacgaaaaaatggaccgcttccatattggaagcggtccatgcggtatcagctgatcatgtcagcagcccttaccctcaggctttcttgacattctccggagtgtcgatttcgaacacgccgtagctccaaccgtgacggtgatagacgacggacgggcgtccggtctccttgttcacgaacaggaagaaatcgtgtccgatcagttccatctcgtacagcgcctcgtcgatgctcataggctcggcgatgtgcagcttgcgacggatgacaatcggcgtatccccaacctggacctccacggattcgccagggccaagatcggaggcgaccgcagcctgcgggctgttgttcggctcttcctccggctcctccgactcgggctccggggcgataacacccagatccaccggaaccgggttcgcgtaaccacgacggtgatccttgcgacggtcacgagtacgacgcagacgcagcgtcaacttatccagcgccatgtccagcgcgctgaattcatcggtgctggaagcctccgcacgcaccacggtacgtccggcgataacggtgatttccacgcgcttggcggtatcggcctgacgcgggttgccctcatgggtcagcacgatctgcgcgcgctgagcatccggggcgatagcggtcacacgattcatcttggtctcgaccacatcacggaacctttgcttgacctgcgtgtggcgtccggtaacgacgatttccatgttgacctcctctaactcaagcggtgtaacccgctatatgtgttccgaacggcatcatcaccgaccgggtatgtttcattgtagacgaacaatgggtgaacggccggaaactcgcccagagaatatatgtttgttcccgggcttttctctgcaatgaaacgatgtatatactggggctttggcagcagtctcctataagaagatttgataccggtttatcaggctggctcgtttgttcgtcatggtaaatactgcaatggataggcagcgttttcttgctctttctcgcacataccaagctcttacagatttgattcgtctccatacgacacgccacaacacgcccgacacgccccatccgatattcggcgcgtcgttcacgaatcgcccaactatgcccaaccatggagaaaacaggataaccgggcaacgtcatggcctcaccgcagggcgggatgccgccttttccgcaccttatgtataattgcaagcttgagacctcttgatggccgcggccgtgatcttcattgggatcggctgaggaacttccgggctccatagagcacgatggcggataacgtccgcccagggtgacctgagagatagcgcaacagagaacagaccgcccgtcctcgacgggtaagggtgaaacggcggtgtaagagaccaccgggcctctggtaacagtaggtcgcatggcaagcctcatcgggagcaaggccaagcagatggcggtaagggctgctcgcccgtgtcatcgggtaggctgctagagcctggcggtaacgtcaggtcgagatggatggccatccgtgccgtgcgttcgcgcacggcacgacagaacccggggtataagaggtctcatttttttcttggctacaccaacaattcggcggcgactcgacggagggtttcggggctgtggcctttgcggccgccggcggaccaaagccgacgctgacggacccgacgatcaaggccatgggttttgcgggctatttggcggcccaattcccatgcggcatcttcaaagatgccattttgctcagcttcgtcacacacctgttcagccagcttgcggtccacacctttgcgagcaagttccatgaccgtaccacgacggcccatcatgcgaccggcacaatagcgtacggccgattcggcataagcgctgtcgtcaatcagttgcacgcgaatcagccgttcgatgacctcgtccacgatcgcctcgccgtaccctttggcaagcaatcgttcgcgtaacgcaccggatgcacgcggggccgcgtccagcaaacgcaatgcagcctcgcggcaagcgtccaaatcattgggatcttcgacaacggcagcgtctctcccccatcgagaaaaacgtcccgacggtttcgactgaacatgctgctcggcaatgggcatgtcttgcgacgcaacaggattgcgccgcaagaacgcttcggcactaatcatgttcaggccttagctgtgccggccttggcacgggtcgttttggcagcaggcgctgctgcggccttgctgtccttggccacgtcggccgcagcagcctcgctgacggcggccgctgctgcggcttcgccatcttccgcgaactgatcggcggaaccgatcagaccgaactcggccttgaccttgttctcaatctcctcggtgatggccgggttgtccttaaggaactgacggaccttctctcgtccctgaccgagctgatcaccctcataggtgaaccacgaaccggacttcttgaccacgccaacctgctgggccatgtcgatcaccgagccctcacgggaaatgccttcaccgtagagcatgtcgaattcggcggacttgaaaggcggggccatcttgttcttgaccaccttgacgcgcgtgcggttgcccaccgcttcgtcgccgttcttcaaggtctggatgcggcggatgtcgagacgcacggaggcgtagaacttcagagctttaccaccggtggtggtttcagggttgccgaagaacacgccgatcttctcacgcagctggttgatgaagatggcggtggtgccggcctgagccaacgcgccggtcatcttgcgcagcgcctgactcatgagtcgggcctgcaaaccaacatggctgtctcccatttcgccttcgatttcggccttcggcactagggcggcgaccgagtcgatgacgatgacgtcaagcgcaccggagcgaatcagcatgtcagcgatttcgagggcctgctcgccgttatccggctgggagacgatgagtgagtcggtgtccacgccgagcttgcgggcgtaggccgggtcgagcgcgtgttcggcatcgatgtaggccgccacaccgcccttcttctgggcattggccaccacatgcaatgcgagcgtggtcttaccggatgattcggggccgtagatctccacgatgcggcccttgggtaggccgccgatgccgagcgccatatcgagagccaacgaaccggtgggaatcacctcgacgttctgctcgggctggtcgcccagtcgcattgcggaacctttgccaaaactcttctcgacctgcgccagcgcggtgtccagcgccgccttgcgcttgggatcgagctcgtgcttgtcctcagctgccgggtccttggccggcttggtctcaagtgccatgatcttctccttgtcgaagtcgtgtgcgaatcggatgcctccaccgtatgacggacatgccatgtgaggcaatccaaaccaaccattgtggttccagcttgcccgagcttggccacctggcctccttaagccctactgcggtaaggattatggcagatggcaagcaccctgtgcacacgtatgcggcttcttgtcactgtggataactataaccacacacacgaacatttgttcgaatttggcgtgcaacacgccgaaatcgccaatttcacgattcagcgactccgtaatcccgcagtgtcagacggcgggcatgggcggagcgttatgatcgtggccccaacgcttggagtccggaacctccatttggtcgcagagcacattccagaccacgcgtggctcctcccccgcgtccagcgcctcgaccacggtcatattcgccagtttgggcatccgttgatcacgcgacagcgaacgaccgtaggtccgaccgaacacctcttcaagtaattcccagaattcccgttcacgcatacacgccagtgtgccaccaaccgcaggacagcaaaaacccgcatcgccacaagcgatacgggttcacagctagacatagattacgggacgcggcttcacaccgccaaccgatcagccctcgaccgagtcgagataatcagccaccatgcgcagcatgcgcgaagtggagactccgagcgcatcggcgatggagctcagcagttcggagctggcttccttctgtccacgttcgacttcggaaaggtagcctagcgaaacgcctgccttctcggagacttcacgcaacgtgcggcgatcgcgcgtgcgcagctcgcgcagcacatgaccgatagcaccacgcagcgaaaactcgcgaggctcctcctcagccaccacgggctcggcggcggcagtcggcttgtacgacggcgaatcctcatcccacatacgttcacgaacggcttgacgctgatccttggccttcttggcggcctgtgccttgagcacctgctgctgggcgaacatcaccgcacggcgctgggccggagtcagttcacgcatacgggcgacacccggctgcacagccatcggcttcttggcggccacatccatctgttcgttcactcgggtcatcgtttccatcgccatcgccccttcccaggtcggttcagtgtttccactatgtacaacacgacaacccaacggttttattccttaaaacttgctgtgaatagactcaagttttgcagaacgtggaatacggtgaggcgacgaacctcttcgcgcatgccatcaagatggagttcgacggctttgagcacttcggcatggtccgcggtgaggcttgcggggatgcgcaggcccacatacaccagtccggccggcttgtcaccgtccggaccggggccggccacaccggtggtggaaaggccgatgattcggtcgccgtattccggctggctgtataggcgagcggtaccgatggccatctgccgggcgacttcggggtgtacggcaccttctcgatccaatagggccttgtccacgtgcaggatcgaggccttggcattgatgtcgtaggtgacagcggagcccaacaacacgttggaggcgccgggaatacgcacgaacgcatcggcaagcaggccaccggtcagggattcagcgcaggcgattttcgtattgttcgcctcgcaaatcttgaggatgccggccgcgagactgtcgcacaattcccgcattggaatatccgtcacttccgcttcggggcgacgaacgtgttatacaggtacacggcacccgagtagaggcacaggaccaatgccacgtagatgatggcgtaggtcaggaagtagtaagcggtcatccagaacggcgtggcttgtccgttacccagagaccagaacggcagcagcagcatggacagacccacgcactggaatacggtcttgagcttgccgggccatgcggcggcgatgactttgccgcccggacgctccataacgaagaaacgcataacggtgataccaatttcgcgaatcaggaacaggatggttacccaccagccgagctcgccgaacgcggagcatacaatcattgcgccgcaagtcagcagcttatccgcgatcggatccatgagcttgcccatttcggtgacctgattgtatttgcgggccatccaaccgtcgattttatcggtggacgcggcgatgatgaacagcaccgcggcgacccagcgcatggtcaggttgttctcaccccaggcaccggcgagaatgtcgagtgtcaggaaaatcaccacgagtacgatgcgcgagtaggtgaccaggttcggcggcgcgttccatccgtcgaacagcgatgatttgggcgatgactgcttgtccattgtgttctcatccatagtgttcacgttacccccacacttctaccttgagtgagtattggctggatattgactgctattattcgggaatcaggttgcgtgctgatggccgcgtggccgcgcttctctccctccgccccttcggggcacctctctcatcagaggaaggtcgatggcgaattattcgccgagttcgggctgttgcggggcggtggcttcgagcgagctggtttcgcctcggatgaaggcgagcacctgcggcaggtcctgcggctggacgagcacttcgcgggccttcgagccttcggacggcccgaccacgccacgcgattcgagcaggtccatgagtcggccggccttggcgaagccgaccctgagcttgcgctgcagcatcgaggtggagccgaattggctggtgaccacgagttcggcggcctgcagcagcacgtccatgtcgtcgccgatctcctcgtcgggctccatgttgtctttcttttcggcttccttggccatctgttcgatgtcttcgcggtacttcggcttgcgctgggtgcgcacgaactccacggccttgcgaatctcggattcggacacccacgagccctgcacacgaatcggcttggcggaacccatcggcaggaacaacgcatcgccctgaccaatcagggtctcggcaccgaccgtgtcaagaatgactcgcgaatcggtggcggacgaggtggcgaacgccagtcgggatggaatgttggccttgatcagaccggtgaccacgtccacggacggacgctgggtggcgagcaccagatgcacaccggcggctcgtgccagctgggtgatgcgctggatggagctttccacatcgttcttggctaccatcataaggtcggccatctcgtcgaccaccacgaggatgtacggatagggggccaccttgcgctgggagccggcgggcgcatgtaccttgccggcgcgcacggcctcgttgaagtccttgacgtggcggaatccgaagaattcgaggtcggagtagcgtgcatccatctctttgaccacccattcgagggcctgtgcggctttcttcggatcggtgatgatcggggtcagcaggtgcgggatgcctgcgtaggcggacagttccacgcgcttgggatccaccatgatcagacgcacctgttcgggcgtggcacgcatgatgatcgaagtgagcatcgagttgataaaactcgacttaccggaaccggtggcaccggccaccagcaggtgcggcatcttggtcaggtcggcggtcacgaagtggccttcgacgtccttgccgatgccggagagcatcgggttcgggtcgcccacggccttgtcggagcgcagtacgtcgcccaagtgcacgatttcgcgatcctcgttcgggatttcgatgccgatggcggacttgccgggaatcggtgaaaggatacgcacatccgaactggccaccgcgtaggcgatgttgcgctgcaggttggtgactttctccaccttgacgccggggccaagctcgacctcatattgggtaaccgaggggccacgcaggaagccgacgactttggcatccacgttgaactgttcgaaggtggaagtcagcgcccggatcacgcgatcgttggccggggtgcgcatcgcatggggctggcctttggtcagcaggttcaggtcgggcaactgatacggcctattggcgtcgtcgtctgtatcgttgccggcggtggcattcggctggccgcccgtattgggcacgccctggccgactccgctgccatccgcatcggcacccgcgtaggctccggtcgcggctgccgcagccgcggcaccggcggctccggccgctcccatcgcaccggctgcccctgcgagcgcgacagtaccggcctgggcggcactgggtgcccacgggtcgtctaccgctcccccaccgggcatggcgacggtctggccactggtgatgacgcgggttcgggaagcgtcgccatcatctgcatcggcagcaggcacagggctggataggtgcggacggccgtcgtacgaagacgatgcaatggttcgcgcaccgataatctcgccggtcatcggatcgaccaccggggtttcggcggtggcaccatgctggctggcggcacggtcgaatggatcgtcggcagcatacttgtcaagagttttgtcgtcttcggtcttggatttgcggccgaacagtcgtgcgaacaggctgggccgtgcatcgccggcctgatcgtcgtcgttgccgtcatcgtcgccgtcatgcgagggaacaccgtcggcaaaggcgagagtggtatctcccacacggacctcgttgggaaactggctggcgctcccatccgtctcctggcccatcggcacatacggtttgcgctggattttagcggcgattttgcgcgcatcctccggcaaatcggtgacgtgggtgccggtaatcatcagcaaggagaacaggccgacgaccacgaaaatgatgatggcgaacacgttggaaaggccccaggcgagcggtgagccgaggaagaagccgaacaggccgccggcggattgcagaatcgtgatgtcgaatccggtgtggtcggcggcgatcgccacgtcgatgatcgaacaaatcgaccacatgagcagcacccaaccggtgaccacacgcgggttattggaccctttaccggaattgcgcatgagtcggaaggccacggcggcgagcaacaccggcagcacgacgctcatcagaccaagcacaccggccgcgatggcgtgaagcagctggccgaatggaccgctgacgcggaaccattcggacgcgcagaacagtacggcgagcacgagcagcaggaagcacaaaccgtcacgacggtaggctggatcgtattcgccgacgccggtgacggcgcgtacgccggagccgaacgcgcgcggaatcgcgagcaggatcttcttccacaacggctcaggttcgaggtcaagctcgggctggaccttggtttcgccatcatgggtagacccgttgtctttggatttacggggtttggtgctgttggaggatgctgttcgtgccatatcgggtctgattctactagtacgggggtgcatggttggtgacgacaccgtgacgatatggtcgattgacgaatcccgacagccgattcgccgcgttcgtctgagtcgattccccgctggggcgcgaatatgccttatcatgggttgcatgacatccgcagagcgtgcgagcgcagtcgcatttgcactcaagaactgcgcactggaagcgatgacgccgggcgaggcaacgatgcgcgccgcggctgcctacgaacgcggcttgaagcccgtgacccatctcatcgacgtggcggacgaacagactgccatgcgtctgcgcgccgccgccgaccctgccggaaaggaccgtctggctgccggcagtctggatgatcatgccacggatcgggcggatgcggtgttcgcacgtaccgtgttgttggcggaacgtcgatggaatccgtctggcgacttggatgagctgaccgccattcataaggggctgttcgaaggcgtgtttgaggatgcgggcaagttgcgtacctcaaacaccacacgcgaggtgacgaacgaccgggctcgagccgcgaatcctgaggcgttcttcccggctgggctcattgagaccggcgcgcacaacatcgcgatggagttggcggacaagcgcaacctgcatgcgttggatcgcgacgtgttcgttcacgcgttcgcttctatttatgatgagctcggttatctgcatccgttccgtggcggcaatgcgatggtgctgcgtatattcggttcacgcttggcgcatgacgccggctgggatctcgactggggctcagtgacgcgcgaggagtatcgctccgccaagcactcggcatatcggggcgacacgtctgcactggagacgatgttcgacgcgatactacgcccggcgaatccgacgcgtgtgttcttgatcgccggctggaatcaggggcctgcacactgattgcgggtgattgcatcggcctttggctgattcctacgccgtgatatcgcccagatgatgctgggtgtattcgtcggctcgggcgtcgatcgggtcgtagtcgccggcgtcggcgtgcgcgataatggccatcgcgttgtcgaccagtttcgggttcagggcctgcagccagtggatgcgcgggtcacggccgaaccatcccatctgtttgcgggcgagtcgcttggttttctgtgcgatgtccgcgaaggcgtcgttcacatcccagatgccgtccagcaggtcgatgatctgctgatagccgagcgcacgtacggcggtggcacccagatgcgggcgcaaccgttcgacttcttcgatgaacccatcgtcatacatctgcttggtgcgcaaatcgatgcgatggtccaaatccgggcggtccaggtcgagtccgatctgcacggacggaatcacgtaccggtagcgcggcagactggccgaatacggtttgccggtaagctcgatgacctccagcgcacggatggtgcggcgtggattgcgtgggtccatgcgcgcggcggcctcggggtctttggcccgcaactcgtcgaacaaagcaccggcaccctcggttttctcgcgttcctcaagacgtgtgcgcacgtcgggatcggtgccggggaaggtgatgtcatcgatggccgctctggcgtacaagccggagccgccgacgagaatcggccggatgccacgtgattgcaggtcggcgatggtctcgcgcgcaagctgctggaatcgggccacgctcatcgtgtcttcggggtcgatgatgtcgatgagatggtgcggcacggccgcctgttcctcggcggtgggtttggcggtgccgatatccatgccacggtacatctggtaggcgtccgcgttcacgatttcggcccgctcccccgcttcggccagacgccgggcgatggcgatgcccaaccccgtcttgccggacgcggtgggaccgacgatggagacgactcgttgcgtcatatacgccccctcagtgccgcacggaataggtctggccggcggccacgtcggggtcggcaagcagattatggcggccggcgtgtgtgacggtggccgtgacgaaatcgccgatttcaggtaccggttcgccttcaggcacgccgatgtgcaccagcacgccggttttctcgcggccggtgacacggtgggtgtcggtgtccttcttgccgagtttgccggtgatcatcacttcgacgtcgcggccctcgaatgtggcgaggttctcttcggtgatctgctcctgcaacgccaccagacggtcgaaccggtcctgcaccacgtcgcgcggaatctgttccattgcggcggccggcgtgccggggcgtggcgagtagatgaacgtgaacgccgaggagaagcgcgcctggcgcaccacgtccatggtctgctggaagtcctcttcggtttcgccggggaagccgacgatgatgtcggtggagatctgcgcgtcgggcatggcggcgcggatgcggcccagtatgtcgaggaacttggcggagcggtaggagcggcgcatcgcgcgcaggatgcggtcggagccggactgcagcgggaagtgcagctggtgcatgatgttcggcgtttcggccatcgcggcgatgacgtcgtcggtgaaggcggccgggtgcggcgaggtgaagcgcacgcgttcgagaccgtcgatggtgccgcaggcgcgcaacagcttgctgaaagcgtatcgatcgccaataccataaccgaacgaattcacgttctggccgagaagcgtaacctccttggcaccatcggccacacattggcgaatctcatcaagaatgtcaccggggcggcggtccttttccttgcctcgcgtggtgggcacaatacagaacgtgcaggtgttattgcagcccacggaaatcgccacccacgagctgatgcgggaggcgcgggcggcgggaagctggctcgggaactgccgcaattgttcagtgacccggacctgcgccttgccggtcgcacgattctgatccaacagcttgggcagatcttcgatgttcttggtaccgaacaccgcggaaacccatggcgcagtatccgcgatcttcttgcggtcaagctgggccatgcagccgccaacggcgatctgcaggttcggccgaaccagtttgacgcgattgaatcggccaatggtgccatacatgcgttcggctgcgttctcgcgtaccgcacaggtattgagcaccagcaaatcgaggtcattgtcattgatctggtcctcggttgcaggcacgtagccattggcctccagcacgccggcgatgcgctcggaatcgtgcacgttcatctggcagccgagcgtatggatatggaacacgcccttgccgcgtttccccagcaaaccatcggttccatcggctgcaatcgaggcgcgctccgcctcggtcatcatgtcttcattcataacgaccgattctatcgacggggttcgtcatgctccggtcacgtatgccattggttgtcacgatgtcaaattatgggttcttggaaagattccccgcgaacgtccagattggctggaatccgccgagtatattggtggacgtgatacttgaccgacatagccgactcaaaacctccgatctgcaagcccgtctcaaagcgttggatcttccgggaggcaccttcactcccgaacaggtcgttgaattcgttgacctcatgcaggtgtatgaaggcgcgatgtacgagatcagcaccaaactggagattctcgacgacgagttccaggtgcggttcagccatgacccgatacatcatatggaacgccgtctgaagtcggtgagctcgatcatcggcaaactggagcgcaagggtctgccgatcggcgtcaattcgattaaggacaatctgttcgatgtggccggcatccgcgtgatctgtaattaccgcgacgacgtgtattccgtgtccaactatctgtcgtcgcagtccgatattcaggtgctgcgcgtcaaggattacatcaagaacccgaaacagaacgggtatcgttcattgcacgtaatctacgcggtgcccgtgttcctctcctcgggcgcgcattacacgccggtggaggtgcagttccgcaccatcgccatggattattgggcgtcgctggagcatgcgctgcgctacaagaccgatttgccggacaacaagctcgccgagcattcccagacgctgctcgactgcgcgcgctcattgcagaacatcgaggtacagatgcagaacatccaccgcgacatcaacggcgcgccgcaagtgggcgaagcgcctaagacctcggactgaggtgctatggaatcggcctgcggccgattcattcaccgttgcggccacttcggcagcctggccggcgcttgggccagtagggtgccgaggaagatgagggcgcagccgaggtagccgcgcggggtcatcacttcaccgagaagcaacgcaccgcctaccgccgagaagaacgattcgaggctcatcagcaggctggctcgcgtcggtggcacccattgctggccgaccacctgcaaggtgtacgcgatgcccaccgagccgatgccggcgtacagaatcggaatccaggaatgagcagcgccggcccagtcgaccgagccttcgatcagcgaacccgcccagctcagcacggcggtggtgcagaactggccgaatgaaagcttgatggcgtccacggtgccgcccaaagtatcgatcaccagaatatgcacggcgaacagcacggccgtgaacacgagcaggatatccgccaggccgatcgaaccgaaaccatcggtgatgcacagcagatagaagccggcgatggacagcgccacggccacgaacaccagcatgccgatgcgccggcgcaggaacacgaaggccagcaacggcaccatcacgatgtacatggcggtcaggaatcccgcacggccggccgatttgccgtacagaatgccatactgctgcagggtgctggcggtgaacagcacgatgccgcagatcacggaaatgaccaccgggttggcgagcaatcgcgccacggccgaatcgggcttgttcgcattcagcttggcaccggtgatggtaacgacgtcggatgcaccgttcgatgcggcatctgtggagacggccacggatgcctcggtcccaacgacatcggccccggctgtatcgcccttatccgcgctcccccggccacgcatccacagcagaatcggcaccaaagacagtgctcccagcgtgaagcgcgcggcgttgaagaacatcggcgacatcgaatccatgccctggacctgcgccacgaacgcaaaaccccagatcagcgcggtcaacaacaggctcagcatgcctacgagttcttgtcttttcacggggagccagcctaacgtgcgaatgtgacagacatgaaaaagcccggccacaatgtggtcgggctgtgacgtttgacgggcaggctacatgccgctcgccaatcggctgtcgaggctagtccctgttgccgagcagctgcaggatgtacaggaacatgttcacgaagtcgaggtacaggttcagggcgcacaggatggagatcttcttgaccatttccgggccctgggcctcgtattcggtcagcagcgcgcgcgtggactgcgcgtcgtagatggtcatgcgacctcagcaccgtcaccacctgacagacccacccacaccaaacagcgaaaggccgaacatttttttttctgatatatgtggttggcgtagatgtggcatatacgaggggcatcctatggcggatgatgaaactcatatcggtcgaaataacgaggaacgcaaggaagacgaaaaccgtcgcattatgggaaaggcgctggaaggtgctgcggcggaaaccgtgcaacgctttggttctgccgtcaaggaacatttagcggcctatgcgggtgatagagagaatgctgccgatggtaattccaaactgtctaagaccttgaagtccattgctgaaacgccgacaagtaatgaattcaaaaagcagaacatagctcagcaagcgggttttagtgccgaggttgagtcggtagccaggaagaacgccgataacattattgctggcaacgatacgcgattcaaacgatatgatgacgtgaagcatccagatggacggcaagtgtcgaacgaccccatcgtggacattgtcgaagtggatgacttgggcaaaccaatcatcggctctgaggctcaaatgaagttcgtcggcagtagcccgaaaaagcttcttgataagttgaaaagcaagaaatatgcaaaatatcgtgatgcagacgtcagcatggttattccggatgattattacgatgtactgatgggtgatgggcctgacggcatcaacgaacagatacgaaaacttcagggcgagctggatggaggtcggcttgccggcaagaattctgaggctattcagcagcaaatcgatgatctgaaacagattaagaaaagcctgcggaaaagtggactcaccaagcgagaagcgttgtatgcgcgagaacatcccagacgcatggtggcgaaagatgtagccagagttgccaataaagccggtctgcagcaggcaaggaatggtgcgctgattggtggtggtgtttctctgattcgaaatatggttgcctgcattaatggctctattgagccagcggaggcagcgagaaacgtcggcgtcgatgcaggcttggctgcggcgttcggctatgtcaccgctttttccggcgctgccattaagggtgccatgcaaaacgcgtcgagcgagtatctgcgtagtctatcgagaacgaacgttgcagctacgatggtctccactgtaacggatgtttccaaggtggttgcactgtattgccgcggcgagattactggagctgtttgtatagagcgcctcggccagcagggaatggggcagctcggaggagtgatgggcgttgccgtggcgatggccgcagtacctgcagatggtgcttttatggctgcgatggttggtatggctggaagcaccttgggatatgctgcagctgttgccgtatatgaggaattatccactgctctgcatgactatgagctggcgaaagaggagcgtattcgtgtggaacgcgaatgtgcggaagcggtggagctcatccgccaatataggcgtgatatgtctagggatgtcgagaattatctggcgactcatgatgaattgtttaatagagcattcgatgcaatggatcaagcgttgatttccaatgatattgatggatatttgaccggaaacgccgaaattcaagaatccttgggatacttgccaaggtttcggactcagcaggagtttgatgatttgatggcgtcagacgacaatttcgttttataaggaggagccagttaatgaagtacatcaaaacacgtgatgcattacaagcattttattatctgattgctgtcgatggatcagtccgtgacgacgaacgcgcactattcgatcatataggtgacaatttggatgcaaagcacttccatgattatcgcaaagagattatcgattcgtgcgatgagcgtataaaccagtgccacgattccgatgatcgctacgacgtaattgttgagggtgttgatgcagtcttgtcgcatcgaacggataaaagagctgcaggaattgcaccaaggctgcttctgtggaatatgttgtcagttgccttcgccgatggggaatatgatgcagtagaaagcagactcatcaaacatattgcccggacgatgattgccgatcgttccatataccccgaaatggaacatcttatgcgcgcggcgtatgacgtgcgaggcgagctcgactggatcagcaattccgaactgccatatagtgaagttcgccccatggtggatcagctggaagagcgcgtgaatgttctccaaaacgctgccgtgttgctgattgaagacgagacggccgcgccagccccggaagtcatggttccagagaaggacgtgtttgatcagaccaaggatgctgttgactcggtggtcgctccggttgtggatcaggttcagcagggtgctcagggagccgcggatgcggtgaagcatacgtttgacaataatgttgctcctgttctcaaccaagttggcgatgcgctgaagccggtgaatgatgcagtgctgaaaccggtaggcaacgcagccaatgaggttgcgaaacgtgcgggtgacgcagccaatgaggttgcgaaacatgcgggtgacgcggccaatgaggctgcgaaacgtgcgggcgatgcggccaatgctgtacaaggcttcttcggtggcctctttggacgcaaataagagaaacccaggaaggaattcactatgccattttttgttgttccactattcatcggaatggccgctgctgccggtaccgcaggcgtgggtatggctgccaaaggtagtcttgatcagcacacggcgaatcagcttaacgacaattccggagcacgcattcgatgggcagctaataacctcgaaaagcttcgtgggcaatgttcagattccctgaatgccttgggcaaagagaaagtcattattttggatgggagcgttcagcgcttccttggtgcttttcaacagctgaaaaatgttgatttcaccgcgtccgaagggcttgatgaactcaataaactgcgcatagacaaagcggcttttgatgaacttaaaaccatgggaaacatagcttcgtctttgctggaaggcggtgtggccggggcagccagcggtgcattggctgcgtttggtgcatatagtgccgcgtcggcacttgccacggcttccacaggaactgcgatcagtgcattaagtggtgtggctgcttccaacgccacgttggcgttcttcgggggagggtccttggccgcaggtggcttgggcatggctggcggagccgctgtacttggaggcttggtggcaggtcctgcattgctggtcatgggcgttatcatcggtgccaagggtggcaaaaaccttgaggaagcgaagacccagtctgctgaggcaagcaaatactgtgaacagatgatggccggtgcggaccagtgcgttgccattcgtagacgcagctatatgttccacgctttgctcgcccgtcttgatgctaaattcctgccttcaattcttgaaatggaaaatatcataaagaccgagggaacggattattcgcaattccgtcaggaaagtaagaagactgttgccgcagctgcgtccactgcagcatcaatcaaggccgtactagatactcctctgctggccgaggatgggtcacttactttggagtcggagaagctgatgaagaacagtggcatgtgatgggatgaggattccggagctggactgatggttctgtgtcttcttccgtcatttttcagggcttcatatagatacgacgcatgacgaattctaccaggcgatctgggaggaagcgcttgagttgcatcagggccttgtagctgctgccgacggcgatgcgcaccgggggattgcgtttgccgagcgtcgcgacgatgactcgggccacgctttccggaccgtcgccggtctgctcgtcatgagccatttgcccgaccgaacgttggcattcgtcgtagtacggtgaattggctggttcggcgaggatacgcgagccggtgaatccagtggataggtcacccggttcgatgattgtggcggtgatgccatgacggcgcccctccaaccgcagcgcctccacatacatttccagcgccgcctttgtggaagagtagtgcgattggaacggcaaacccagccgtcctccaatcgagccgacaacgatgactcgtccccgcttacggttgcgtgccgcggtacggcgcagcaacggcagtgcgatttcgttgacctgcaacacgccaaaataattcacatcgaactgcttgcgagcgagcgtcattggtgtgcattccgcagagccggcgatgccgaatcccgcgcaatggacgatagcgtccaatcgggggagagcgccgagaatgcgcgtgatgtcagccggcttggtgacgtccatttcgtaggtaagcagttcgctgtggccaagacgctgagtctcagggatattctcgtccgcaccgagtcccactgcaatcacacgccaaccccgcacagcgagcatccgtgcagtcgccttgccgataccgctcgtgccgccggtgaccaatgccaccggccgtccatcatctttgattggttccatgtgtactattatcgcgcggtggcgatgatgaaatcacggcatagcaataatgcaagttgccgaacggatgagtgaggctcttagattcatggaagacacaatgaaaaaaagagtggagcaaccttcttactggaactcggcaatgactctagaaaacgtataccagtgaaagcaccagcaacgtgctattctataaacgtttctggtttcaaacacttttttgagaggtgcgtatgggtcttatacaagctgattttggtgatgttgaacgtcggtccactagtaattcagcagatgaggctttccaacgcattttcgggtttccgtcttctgtaatccgggaatcagcatggcgtgcactgcgtgtcgctactggaactgatggtgtccactcccaattgagtgcggcgggatcgaagttttatcatgagtttgtgtcagaggttcgagctttcatcgataccgttgacgaatggagcgcaaattgttcggacgataacaaaacgtctccacgagcataccgttctgatggtttaacattagccttcgcccaaggatctccggctaccggaaacatcaacaaagagttgcatctcaagaaggttccgggaactgtaacattactggagcttcaggagaaagctccggcgaagcagcgagagctgtctttcgatgccttgacctccatggtgccggcgcgtccgcagatgtggttggtggtgtactaccgagaggctgatttggtgcggttggaagtgtcgcttcccgctggtgtggattctaatgggaaaatcattggttgggataagcgacttatgttggacgaagttaatttgaccgatcagtttgtggaggcacgtaacgatgagcgtggtgaagatggagttgccgtcgccatttccgcgcgttgagcagaaggcttcgctgaatccagaacgtatccgctgtgcccgtgaaacggcaggactgagcaaggtgcaattggccgaatctctcggtgtgacttcgcggacggttaccaattatgaagaagtcggagcaccggtgtctcaggtagcggcgttggccgatgttttgcaggtcatgccgtcgttcttttccgtgtctcctagtgctccgctgattgaggatttatcggaagggcaggtatggttcagatctttgaggaagtcgacggtaaggcagcgtcgttcggcagtggggcatggtcggaatgcattgctgttcttcaaatggattgaagatcacttccggctgcctgaatgcgatttgccctttgccgatagcgccggaatgcgtccggacttggcagcgactatgctgcgcgcgattttgggatatggcgagaatccgttgcccgagatgacgagtcttgcggaagctcatggcattcgactatttagtctaccgactgtcggacgagaagtggatgctttcagctttatgttcgatggtgtgccgtatatcgcggtagataccagcaagaccgcagaacgtgtccgtttcgatattgcgcatgaaattggacatctgatgatgcatgaaatggtgtctgaagatgtagcggctgccggaacgcgcgatatcgaaggtgaagctcattcgttcgccgcgaatcttttgatgccgaagcgccgtgttctgggcatggtgccgactcacgcttcagtgtcgcagattttggctgcgaaacgatattttaaggtttccgcaatggctatggctcgccgggcctatgagctgggccgattgtctgaatgggaatatcggcaggtttgctcggaactgacggttcaaggatacaagagtggcgagcctcgtggcctgcggccagagcagtcgaaggtattccgcttcgtggctgatacgaacaggcagaagggcatatcggtttccacggtgagtgaggagaccgggcttgtgcccaaagaattgcatggattgtcgtttgggaatatttgggcggttactggtggaatggtctgagccagagagctatctcgaaccgaaacaaatccatttgaattagcgttacaaatctgtgctgacaatgactgagtataaccccttgttagttcgagaggtcgcttcactggatcccgtgagcttcgttggtctcgtttttggcttaatgatgccgttttcgcgaccctcgcgagattcgttgattgccgttgatttcgctgttctcaggggtcatcgtgtctgaatcgtgtctgagccacagacacgatgacgaacgtcattccgcgactgaagcaaccggacgactgaggaacaatggattaagccacaaccagtgggctcaacgtcgcaatcttcaacctctcttcaagaagtagtttatgaagcaaattccttccatgtgcctccgggataactgtctccccatatcggttcatcagttcgatgattgcgtcatagttaggtccatgcatggtcgtgtagcagaaagtcagctttgttttgcttccatacaaatcaacttgatcgaaaagcgactggaagtaggagtaatcagcctcccctaatgaatgtccaaagaatttgatttccttgatttcatctccattttcctgagcgtcaaagatagatctccctttcatttcttcaggtaggtattggttaggtagctctaggaccctcgcagtcttagtgaattgatagatttctggtttatccatgcgggacagaccgtctatgccaaatatcacatgatattctcgaccaaaagtttgactgtactcgtaattcccggtgtctccatgtacgtttctctgataataaattgaatcatctattgacttctcaagaagcggtgtcgtgtaattaaaagacaggatgacattagcttgttgctcaagaggaacacttgtgccgattgttgcaatctctttgtatgtgtttttacatcctggctcgtatgagggattatcttttatggttttgattaggtattttgcaaattcatcttctataatatgaagttctaatgcgaagaatttaagtacctgttcccggaatctatcccgctcttcatctaaggatggaaactctaagattgagaaatcaacacttggcagtttttcccgcagatgcttcttaatcatagagtatgcagctttgacttcgtcagtatgatcctctaccgcaagaccaccctcccaaaaatccattgcatcattgagacttatcgcatccttcccgacaacccattccttaatggcgctctccacgtctttccagtcatcaaggttcttggctgtgtcatgccaaacagcaaacagataatcccatatacaattaccgtcgtcaagaggatcgtcaatcaatttcggcatgagcaaaggaacaatacccttctcattccgatatttcctgtatctatagcggaaaaatgcaggataggatgacgggatatgttgcgctaaatcgaatccattacctaaaacgataatctgtgtatatgccaattaaaacctttcccacaagtcagcaatcaggacagcatctttggttcattagttactggaattaatggatagtttttcagcctttacctgtttaagttgttgactcaaactcgccagttttgccaaatgcccgtcttcctgataggtctcctcaatcaatgtatccatgaaactgagaataaattcggcatagtctttgctgatctcttcaaagatattgtgagttgatccgttaccgacatccttgattgttgctgcaagatctccgaggcgcttactgattacgccttccttggcggcatccctgagcttcgcgttaagagtcttgtctttgccatgttcattggctgggctctgaatcttttccgtgatgatgacttcgagcacgcttcgtgccataatcatgcctaccttcttaagagcatcttctatttgctttgattattcataatcttaaaggtgagtcaacaaaagcggattgacctaaccccacttcactttcaaaactcagtatgtatcccctcatctgttcgttcgtagagttcaccaatcggcgtgcagcctgtttctcatggagagtgttaagtatagaaagaacatccgcatccgcaatgcctcttctgagatccagcgtacattcaatcttaggaaccggaattgagtaactttcagtttcaacatcatgcaggatggccttttcacgcaaccacaatggatcgatattcctcgttatcagtactgtgtctcggctcgacatgcctgtttcatattccagtcttgcctcgtgggcatcggtgacgctcatgaaatagcagtcccatgcggcattccaggccttatgagataaatcatcaatggattcgttgccggaatacttaatcaatctgcgtgcttgttccgctcgattgccgttccccgtcaatatgtcaatggcgacctgaagctcatacgccgaggtagcccctaactggtcatttacccacgatacatattcagccagcatcattaagcgattatctgtattcatcttttgtgccaacagcattatctttagtaatgaagcataatgaatcgcgaactgggtgaagtcgctaattattccattaaacccgtatgccaatggatctatccgcgtctgatatggccggtctcgacattttttatcgcgattagcaagagggtgatgattggaaaattgtttttcaatcatcaccttatcccactgaagcattgtctctgcgacatagcgttttctttggaaattattttcatcgaatccagaacgccattggtgacacgactccaacaaagcgaatcctatacatggatctatcctgtttttatcaagatatagcagcaaatccttcagagactggcgctcctcctcgcttgtttgattgaagtagaaatgctccatatcaataacaacatttgtatctaatacagcacattttggcatagtgccatcatctgcctcggcggaaatcaaactatatgccccaattcgcaaaaggattcacatctcctaaactcgtaagttctttagctttctttgaattgtaatcaattccatgctcacaggcaattttgtcagcttcctctaatatatgatcctgtgaaaatggaacagaatacatattgactcttgccaagactttcttatttacaggacgttttgaatcccaaaaaaataagcgattccatcaaatcttggcatggctggttgattaacaaggcagtgactgattatttggaggtttgagtaccgggtgttattgcgaaacggcaccggtgttattgtgggccggcaccggcgtgcttgacgttggacgctgccggtgccgttcctgttcttttttttgggggggcggctaccggacgggcgcgtgttcgcacatgttgtattcgccggtttccagctaggtggtgttgtgtacgatccggtccatgatggcgtcggcgtgtgtatgtgttcaattggatgttgaggaaaaacactgccgaacccgcccaacaaacattgaagcaatacaatttcgcggctgaccgtggaggcgtgtctgccgatcaggccggcgatccgccgtatgcttgtcccgttgtcgatctctatctggatgatctgccgttcctcttccgacaggtgcgaatgcacttgacccaaggtgcgacaccctttcactggttatctggacaatctccaatttaaagggtgttgcacttctaaatagacaacgggcacaccctagtttaatggcgatactgctatgcttgggagttgctttcattgccataaaaagcaattgaattttcgcgtatttggaggagagatatggaatatcaagaagagcttgccgttgtaccgttggtgccggttgatgctactccaagtacggacactatgctgcgtatggttttgaatcatgaagcgttgttggttcatcatgtcttgaatgattccctctccggtcgtccagggcaggttgcccaggcaacgggtgcgttcgcaaaagcaatcagtcaggttactggcgaatttaatcgttccttttcaacggaaggcctttaccgagtagtacttccggccggttcgacagccaaagatctggtaccggctgtaggtggcggattccgaggcatggtcagggcagctggctccacgcgcatttccggtcacgctactttgcttccagttgcgggtattggagcaacagtagcagtgggaccgttgatcgcgactgtagctctggcaacagtttctgaaatgcttgctcagcatcagcagaataagaagcttgaatccatccagaaagcggttcaatctatacaaacacgcatgagtgatgaagatcgtgccgttcttgtaactgcggaacagcaagtgcaaaaagtgaccgggtatttgcttgatagggcttctattcccaagatttcgtccgctcctgcagcttttggcgatttgaatacgctagcgaatcggtggggtgaacgattagtacggtggactgagactgtacaacaatattcccacaaagatcgcgtgtacgggccggaactaatgctggctcttaccggtgagaaagagcacgcagaacaggcgttggagaatatggtggcgcaaacctatgaggcgttggcgttgcgcgctcgcgtcgtcgttttggaaaaggttgctgcagaatctgaaaatcagaacagatccttgcctcatgttgaagcagcgttgcgcgcagaattgtctgatattgccgctcaacagacacagctgaccgaattgattgatgacctgagtgcaatgccgctggactcttccaggttgccagtgcatgtggcaggtcgaggaatgattaatacacgcactagctttgcgcgactttcaaaggcgctgcattccacaccatcagcgttgcccattcttgatcaattcgatcgaatgatactggatgccgctccgactagcgacggtttgtcgattattacgccagaagaaaatacggtttcaacacctgaagcctgatggagaaagtcgttgcgctataccgggcgtctgttggagaacgtggtgttccttgaactgatgcgtagggagggggatgtgttcgtcgggcaaggcgtaggcggcgagattgttttcattaccaatggcgcgggcggccccgatactatcaggtgagcgaatccgtgcacgactcgcgaaccttggaacgcgaactgtcgtcgttgcgcgcagtaagggataactatccgaagacactgatcacgctggatgatgaacgcccggtagaccacgaggggattagacaggtgtatgccctggattggttgcttgacggtaatgagtaaagcagatataagccatggctgggatgttgcatttggtgcggcatcccagccaacgcgtatcctgaagtattcttgtgctgagttatgaggagggctgatggctggttcgtatggtacggaggattcgcagaatgagcgctatcggttgtcgttcacggtcgggggattgctcgccgaacaggggaggattatcgccgcgctcttttctgggaaccgcagcgagcatgtgaatcccgattcgaaccccgcgaacagaacaacagaagcgaaacacgaaatcggggaacgcataacccgcatccgcaagcaggctgtcgaagagaacgtgctctccatccgcacccgctcggcgaactcccgcgttgtcagcgaggtattgaaacggctgagcgcgctcaccgagacggaaatccactacctggcagacgatgacactcccgcatcggatcgccaggcattgatgtgggtggccatgtgccggtattacgcattggtgggagaattcgccaacgaggtgctgcgtgaacggtatctgatgggattctcaacgctcaccaaggatgattatgaccggttcatccaagcccaatcgatgtggcaccctgaactggaggagctcagcgcgctcaccgccggcaaactgcgctccaacgtgttcaaggccatgaatgaagcggaattatgggaaaaggaaagtgacacgctgctgccttccctactgagcaagtcggtgaccgctatccttgaaaacaggcccgaatcattccgattcttcccaacgcgggaacgatgaaggacaatcagggcaccggaacgcaagcacagacagcttcatacaagagcgcatgaggagagacggatatgacgaatcccgatgacgagatacgtcggcatccacgcaccatcgaacaagacttcgaagggctgttccgcacgatgcgaagcaaacgcttccgcaatggagaagacaccggaggcgagccggcgaactacatctacgcataccctcccgaacaggaactggaagtagaacgccgaatccccatgctcgtgaaccgtctgcaaagcatggatcccgtggattccaacgattctgcgcccggcgtgctggtcatcgatctgtacaagacagtgatccacatcatgcagagcgacgacatcctcgaatcggtcatcggtcaggaagccgaaatgcacggcggcgaaaatgccgataataccgatggcgattcagacgaatggccgcacctgcaggaggacgacttctatcaggcgctcgcaggcatgttcgatgcggatgcgggcgagctgaaagatgccctagcgaaccagtaccgagatgcggcggcggaacagagagcccacatcgtgtttctcaccggcatcggccatgtgtacccgtatatccgcgcgcacgccatgctggatcttatccagaagatttttcctgccagcattcccgtggtgctgttcttccccggcaaatatgagaaaacggcgacgaccgtctcggtgatgcgcctgttcaacaccttggccgcagacaattactaccgcgcctttagcctcaataccatgattacggagggagccaactcatgagcgacgagttgcaactgaagcagatcttcgtcaagaacatcgatgagaagatcgatggcgtggtcaaggccagcgatgacagcaaaatcgccgacgaggtccgcgaatacgtgctgaccaacgagatccagaccaacctcgaacaattcctcgacacctacaatgatccgacagcggattacaccaacggcgtatggatctccggcttcttcggatccggtaaatcgcacctgctgaaaatcctctcccacatcctgggtgacgcccccacccaacacggcaccgatgacgacaacagggagccgatcacccgcaccgaagtcatcgacaacatgaaagccaaggcgcttcaggctgaaaaccacgaacttgaagggctgctggacgccaacctgcgcattccggccatgtcgctgctgttcaacatcgacagcatctcgcaaaaaggcagcaaaaccgcgctgatggacgccttcatccgcgtcttcgacgatgcgcgcggatattacggcgccaacaagtacgtcgccaaactggaacgcgacctcgacagcaacggttgtctcgaacagttcaagaccgagttcgaacggctggccaacaagccttggtccaaaggccgtgcacaggccgcattctccggctccaaaatagaccaggcgttcacggcggcaaccggcaatgaggcccgcgacatcctcaaggattaccagaagcaatacaaccccaccatcgccgacttcgccgatgacgtgcgcgactggctgcagcggcagccggacaacttccgactgatattcctggtggatgaggtcggccagttcatcggcaccgatatcgaccgtatgctcaatctgcagaccgtcaccgaggaactgttctcccgcaccaacgggcgcgtgtgggtgatcgtcacctcgcaggaagacatcgacgccgtggtcggcgaccgtacggtccgccaaggactggacttcaccaagatcaaaggccgtttcgccatcaacctgaaactctccagcgcggatgccatcgaggtcattcagaagcgactcctgctcaaaaccgaacagggcgaagccgaaaccgaagaactctggcgcaagcatcacgacgaattggactccctgttcaccttccaaggcggtggcaacacgcgccaattccgcgacaccaacaaattcggctcaaaagaggacttcaccgccacctacccactcatcaattacgagttcgcgttgttccaagcggcaatgcgcggcatgagcagtgccggattctttgaggggcagcaccgttcggtgggagagcgctcgctgctggccacgatcagcagtgccttggtggattacaaggacaagccggtcggcacgttggtgccgttcagtgcgctgtatgagggggtgtccggcaccatccagagcacggtgaaccatcgcatcaatcaggcaccgcgcgagctcgatgcgcaaacctgccgttatgccctcccattgttgaaggcattgcttctggtcaaacacgtcgaaggcttcacagccaacgtacgcaatctgcgcattctcatcctcgaccggttcgatgagaacatccatgaactggaacagcatatccgtgacacgttggacacgcttgaacgtcagaactacgtgcaccgcaccggcgacgtatacgagtatctgaccaatgacgaacaggccatcgagaacgagatcaaaaacgtcgatgtcgaggaccggcagatccgctcccgcataggcaagatcatcagtggcgacattctcggctctccgcaggtgaattacgggcaaggccggcagaagataccattccgctacggactgtccattgatggcatcgcgcaaagcacgcaacgccccataacgttgaacatcatcacgccgatggattccgccgaacgggatgccaagattctccaatcggcggggatacgtgacgaactgcgtgtgattcttgatgacaatccgctgcttctccgtgatatctatacgctcgaacgcaccgaaaaatacttgaagctgcacgccaacgagcaaggtgcgcgcaaacgcatcatcgataacaagcgcgatgaccttgcgcgtatgcaggtcggattgaaagcaacgctggccaaggcattgtcctctgccacgctggcctacaacggtgcgacgctggaaacaacagcccgcgaggatgcggcaagcgtcgtgacagagggattgcagacgctcatcggtcgcctgtacacgaatctgggcatggtggatggcctggcttattccgaaaaggacttgcctgtcgttctggctgatgcaggtgccaacgccgatagcgcaacgctcgcagagaccgattcggtgcgcaacggcctggatctgcctgctcaggaagtctgcgactacgtcaccggtgagattcggaaagatcttacgccgacggttcgtagcattgtccagcattttgaaggtgtgccgtatgggtggccgttggcggacaccttggcgtgcctgtgccacctgtatggtgccgagcgtattcatcttgtgcttgatggcagccgtgtgccgcgtacggatgtggtcaagtatctgacgaatcagaaaaagaccgagagcatgggcgtggcgattccaaaatcgtatgattccggaaaactcaaggaactgcgcggctttgccggcgactacctcggcctgacggcaggcaaactgccggccgacgccgaggagatggcacaaagcattaagaacgggttgaatgcggagatcaccagaatcgaagcgctgagaaatgccaatggccggttcgtgttcgttgcgcaacttgatgaacctgtacggcgtctgcgtgcggtggcttccatgcccgatgattggattctggaatccttcccgaccgagagcgaggagaccaacaccgatcggctgctcgatgataaggaagagatcatcgacccgatttttaaggtgctcaacggcgtgcagcggggaacgctggtttccggtttggactggatcgcgaccaacgactcgaacttcacactagcctctgccgagcttcagaaggaacgcgacgaggtccgagccatcgctgatgaccccatgttgtttcgcggcaacaaggtcaacctgttcaatacgcgactgaccgtgttgaaagaacatcttgaagcatggataggcgaggagcgggaacatgcgcttgaggtcgtgcaaaccgtgcgcggcaacatcattggcatcgattcctaccgcaacgcctgtgaggatgcgcagcacaatgctttgcatactttggatggcgctgccagcaaaatcaacgacgcgaagtacatcgccgacatccgtcagaccgccgatacggtgaaaggcaatctgtatctggcactggtcaaccggttggacgccgcgaggcaacaggcggaacttcagccagatgctgtcgccgtccatgacggtccggtcgtctccactgaatccgtcgagagtggggatatggagcccaagcatgtcgatgcctcggttgtgccaaccgcacaaccggtaaatcgcaacatccgcgtgctcccgcccaagccgaagcccatgctggtcaccgaaaacgatgtggacgagttcctggacgaataccgccgcaagctcatgagcgccatccatgaaggaaagagggttctgctgtgaacacgaacaagctgcagtcgtttgccgccgagtcgcgaacctcgctgatgaaggcggttcgcgctcgcattgacacggcgatggaacagaattccgccgcacagtccgataatccgcatgcgtaccaaaagctgcgcgatgaaatcaagcagaatggtggtggcgagcaaggcagggcgaagactgcggaacgccacgcctaccgttggttcaaccgaattattgccctgcggtatatggatgctaatgagttcactagcgtacacgtggtgtccggtgaggaactggacaatccgaatgcgttgccgcagtgctatcagcggcgaagcgcggtgaattcgatgaagaggtattcgactcgaacgttggccccaaaaccaaggtattgccgactattcaagccattctggatggtagcaaacctagcaacgacccgcaaggtgacgcatacggtctgttgttacgagcctattgcgattactggcatcggttccttccgttcatgttcgatgatgccggtgccgccgacgagatattgatgcccgccgatctcttggctaaggattctgtactgcgtaaatccgtagaggccatgagcgtggaagactgcgtgggagagaacggcgaaggcaccgtggagatcatcggctggctctaccagttctacatctccgaacgcaaagacgaagtaatggccggcttcaagaagtcgaagaaggccggagccgacgaaattcccgcagccacccagctcttcacccccgactggattgtccgttacctagtccaaaacaccgtaggacgcctctggacccaaaaccaccccgaatcccaactccacaaatcctgggaatactacattgaaccggttggggaagacgccggagagattctcaagatcgattctcccgaagacctcaccgtctgtgatcccgcctgcggctcaggccacatgctcacctacgccttcgacctcctctacggcatctacgacgaagctggctactccgccaacgaaatccccggcctgattctggaacacaacctcttcggcatggagatcgacgaacgagccgccaacctcgccgccttcgccctcaccatgaaggcccggggcaaataccgccgcttcttccgcaaaggccgccaagtccaacctaacatccaacgcatcacaccggaacgtttcaccgatgacgaagtcaccgaactcaacgacctctatggcgtgaccctcgatgccgacacttggaacacctaccaaaacgctgatacctacggttctctcatccaaccgcccacagaattggcagctctagcctcagccccctctgacgagggggctgtcgagcgtagcgagactgggggagagaacacccttttcgatgagggtttgaccaaacgtgccaacctcgtcctcacccaaacccgctacctctcccgccaatacgccgcggtagtggccaacccgccctacatgggttcgggcaacatgggcaacgagcttaagaagttcgtcaacgaccattacaaggacggcaaagccgatctcttcgccgcattcatatatcgcctgctgttgatggttcctgagcatggccgacttggctttatgtcgccatacgtgtggatgttcattagttcttatgaacagctacgtaaacaaataatcgagcacgagcatatatcttctctgattcaactggaatactctggctttgatggtgctactgtgccgatttgtacttttgtgctcggcaaaggacaatcgacagagcatagttcctttgttcgattaagtgattttgttggtgcaaaacaacaggctccccggtcgagggagattattgcagctcatcgcgctgttgctgagggtttatctgttgaagatgcgccaatgtccaaacatttctacgtctgcaaacaacacgatttcgcccaaatccccggctccccaattgtgtattggttcccggaagagcttctaaataaattcggtacacaatcacttggcagtcagatgcggttcgctatcggtatgataactggcgataataatcgttttgtacgttattggtttgaggtttcaacgtctgaaactggctatggaatgactcggacacaggctgtggaaagtggggccatatggtttccctatgcgtccggcggcgagtttcataaatggtatgggaataataccaaattggtgaattggaagaacgatggccatgcactccagacagttaaaacagcagatggcgcgagagtccaagctcataatttcaatcttgaccgaattttcaagaccggaataagttggacgacaattacgagtggagaaccctctttccgtattcaagataatggattcctttttgcggatgctgctggtgtcgcacagggggacaaggccgttgaagcacttggtatgttaaattcttcatattcatcatttgttctagggggtatcaatccaactattaatatgcacccgggctacttggagaagttacccaagctcattttcccggatgatgatctatgcatgtctattgtcacgagtctggtttcggtagctcgctcggactggaactcttatgagacttcgtggggtttcaccagattagggattctagatacgattgatattaagtcttctctgcaggtgattcctatgagggaagtaactgaggatgtcctcgataaggggagtttacgcacgatcattccgacatatatcgaacgatgcaaacatatcactgaagagcaacgtcaacgtgaaatcaagaacaacgaactcgtggcggacgcctacggtgtgcgcaatgaagtgccatgcgacgtaccggtcgaacgagtgtcgctgaaacgtaatccagcattcgcatacccgaagaacacgcctgccgagcgtgacgaactcatgacgcgagatatcgtcaaggagatcgtctcctatgcggtcggctgcatgttcggtcgctactcgctcgacaagcccggtctgattctcgcttcccaaggtgagactctcgccgactatcacgcgcagatcccgaatccctcgttcgagcccgactcggacaacgtcatccccgtcaccgaggatgaatggttcgaggatgacatcgtggcccgattcaggcagttcctcagcgtggccctcggcgagcagcatcttgaggagaacatagcctacatcgagcaggtgctgggcaagtcattgcgcaaatacttcgtcaacgatttttatgacgaccacgtcaagatgtacaagaaccgaccgatctactggatgtactccagccgtaccgacaagaagggcgcgttcaaggcactggtctatctgcaccgctacacgccggccaccaccaacaacgtgctgtcgtaccttcgcgacttcaccgccaagcttcatgcccagtccgaacggctcgcgcaatccgacaaggccagcgaggttcgccagggcgaaaagctgcaaaccgtcatcaaggaatgcgccgactacgagcgcgacatcctctacccgctcgccacccgcaacctcccctgtttatggtcaaataaacgtgtacggcgtcaccaccaaatctgaacggcataagggccgttgagcctgtcgaggaagacaaggcggctgccgcagaagcgaacgctgccgcaaaggccgagagcgcggagaccgtgctcgccgaaccggccagcgaataccagggccgcggagaagagcgaggcccgtgggacgtcaatgatgaggacgtgcccgattatgacgattatctggatctgggcgcctactacctgcccttcctccagggcatccaactgcgtatcaaggccaaccgcgccacccagcaagtgcttggttccaccatcaccttcggctcctccagcctggagatcgaagcctttgccgcacccaagaccttgggactgtgggatgacgttcgcggtgacctgcttgaagccaacaaggccgcttctgaagtggacggtgtgttcggcaccgaactgaagctgccggtcaatgtcaagggcggcaagaccgtgaacacgcgcatcgttggtgtggacggcccgcgctggatgctgcgtggcatcttctccggcaaggctgctatcgatccggacagcccggagaccgaggcgctgaacaagttcttcgccggcatcgtcgtcgagcgtggtgaggagcctttggcgccgcgcgatctgatcccgatgcatccgccggtcgcccccgctgagcgtaaggccgccaaggccgcggccgaagccggcgaggcgaacggcaaggaacacttcaaggacattccggacaacaagccgaagggtccgctgagccaggaccagcagaccgaagtgaagaccacgctgtctcgcggcccgatgttctccgaagttcgctgatttataggaagagacttggcagacaacaaacgcaccggcctgtccgctctagccgacgccggcaatgaaggcgaggatttctccgtcatcgacgccatcggtggcccgcgtggcgtcatcgaatccatgctgcccggcgtggtgttcgtcgtactgttcgtggccacgagcaatctgaatctcaccattgcggtttcggccgtgctggcggtattgcaggttattgtgcgactgattcagcgccagtcggtaatgggcgcggtctctggtctggtggcggtaggcatctgcctgatttgggcatggcagactcatgaggcccgcaattactacatcttcggattcattaccaatgctggctatgccgcgttgcttgccgtgtcgctgattgcgcgcgtgcccggactgggtttggtcgtcgaattcatccgtagcctgcccaccgagcatttcaaggcatggttccatgactggatggacgacaaggccctgaaacgcgcctatatgattgtcaccggcctgtgggtcggtctgttcctgctgcggctggtggtgcaggtgccgctgtatctgaccaaccatgtggctgcactcggcgtgacccgcctgctcatgggcattccgttctgggcattggcgatttgggtgagttacctcattatcgccacgccgatgcaccggcataaggtcgcggctaagaagacacagactgaagtcgctgttgatgccgaactcgaaccgagcgcaaccggaaaggacgatgatgcaagctgaagttcgtatcgaacgatacgccgaccaaggccgctgtgtggcccatatcgacggtcgtgtggtgttcgtccgcttcgccttgcccgacgaactcgtgcgagtcgaacttgacgagccccacgaccgggacgaccggttctggaccggcgaagtcgtcgaggttctcgagccgtccgaagaccgagtcaccccggcatggccacttgccggtcccttggcgatgggcgggggagtgggcggcgcggatctcgtgcacgtctctttgcccggccagctcaagtggaaggccatcaccgtctccgaacagatgagccgactcggccatatcgacgtggccgttcccatcgagcgcatgcccggcgacaaggcagccggcggcctcaattggcgtacccgcatcgaaatgattgccgacgacaacggcatgccatccatgcgccggcgcggcacacacaaccgcgtggccatcgacaccatgccgcttgccacgcgcacgctgctggacgtcgccaagcgcgaacacgtgtgggaaggcggctttgaacccggctcccagattcgtctttccgtgcccgaaccgcgcggcgagatcgtcgataccgcggcagcagacgacaattacgccgtacttgtggacggcgaactgcgcgccggctcccagctgctcaccgaacaggtgaccatcaacggcacgaccttcgactatcaggttgacgccaacggtttctggcaagtgcatcgccaagcgcctatcgccctcggtacgcacgtgatcaacctggtcaacgggcagctgcagtcagcggcggacgccgtaatctgggatttgtattccggttccggcctgttcaccctgccgctggccacaatgaccggtgaacgcacccgcatgctcagcgttgaaggcgcgcgtgtggccgtcaagaacgcccagcgcaatctgcgcgccatgaacctgaacgacgtggacgcccgcgcgggtgacgtctcgcgcacgctggaccatgtgccggcgcatctggccaagccgaatgtcgtagtgcttgatccgccgcgtgccggtgctcgtgccaaggtctgccgccagattgccgcggccggcgcatccagcgtggtctacatcgcctgtgatcccaccagcctcgcacgcgacaccgcgacactcatcggcgaaggctacgagctcaaagacatccgtgccttcgatatctacccgatgacccaccatgttgagacggtggccctgtttacccgctgacaggtgagcatatgacacgacgaattctcggattgctggcctgcatggcggctgtgttgtccctggccgcctgcacgccggccggtagggcggtcggcgatacccaagacagcatgccggaagtcgcccacgattccacacatcccacggatgtcacagtcggctttgtggggtcgactgacaccgccgcagacgagttcgtcatcaatgcgctgtctgatgacaaactcaatgtctactatgcctcgctcgaaacatccgcaagctcggcaaacgcaactgatggtgtatccggtgaaaccgaatcttctgacgccggcactaccagcgaaaacggtgccgatagtatggatgctcatactggcgtcgacaagaatgcggccaccgcacagcagggtgttgccgatttcgtagctcgcgcggtcaaaatcgtggttatcagcggcatcgacgttaccgacgccaaccgggagagctggaaccagacgttgaccaatgcgcgtgaagccggtattccagtcgctctcattgatccaaagcatgcgcccgaagatgaactgctgtacgccgtcatccttcacctcaacaccaacagtgccgattctggcgacactgccgataccaagccaatgactattactgacgccgtgctcaccatcacgcgcgacgaaccccacgaacgcgagatcaaagtcaccgtttcctgagccgaatcaggcccttgaagctgagaaagcaccctgaatcatccctgagccttagcggattgcggaacaagacgcggtaggctggggaatatgagtgcaacaacagccgtggaaatgcctgagatcggagcaaccggtcttacctccaaagaagtggtgcaacgtatcgaaagtggccaatcgaatgcggtgaaaacatccacctcgcgttcggttcaagatatcgtgcgagccaacgtgttcacgctgttcaacggcatcatcttcgccgcgatggtactggtgctgatcaccggttcctggagggacgcggtgttcggtttcgtcatcatcatcaacacgggcatcggcatcgtcaccgaactcagggccaagcgcacgttggataagctttccatccttgtggcctccgaattcctcgtgcatcgtgacggcagggacgtggaggtgccccacaacgagatcgtgctcgacgacctgctgtggatccgtgccggcgaacaggtgccggccgacgggcagatcatccagacctggggactggaactcgacgaatccatgctcaccggcgaatctcgtaccgtgcgccacaaggtgggggagcaggtgtattccggcgccaccgcggtctccggcatggcattggtcaaggtcaatgcggtcggcagccattcctacgccgccacgctcaccgcgcaggccaaggtatacaagaaaaccgtgtccgacctgaacaagggcatcaacacgattctgaaattcatgaccttcctcgtggtaccgctgtgcatcctgctgattctttcgcaggttcatacggtcggtggttggggcgccgcactctccaccggcgaatggcggcaagccgtggtttccgcggtcgccggcgtggtaggcatgattcccgaaggcttggtgctgctgacttcgctgaacttcgcggtggccgccatgcgtctcgcccgtcacaatacgctggtgcaggagctcgaatccgtggagacactggctcgcgtggacgcgctgaacctcgataaaaccggtacgatcaccgatggcggcatcgccttcaaccggctcgtgatgctcggctccgccaatgcgactgcggaacaggcagccacgcagtctctctacgactgctgcaacgaagagcagcccaacggcaccggccaagccgtactcgccgggcttaaggcccaaggatatggggcaggtgcggttgagtctcgtgtcccgttctcttcggcgcgcaaatggagtgcggtgcgtaaatccggcgagacctggtacatgggagcgccggaggttattatttctgcgcttgagggtgactattcgtcggtgttgcagcaggttaacgagtatgccaatgacggcaaccgtgtgttgctggttgcgcggtctacagcgcccctcagtccgcttcgcggacagctcccctcggagaggggagccgagaagagcgagctggcttccctctccgaggggagctgtcgccaaaagcgactgaggggagcagttgagggagccaatgtctcggacgacccgcaactggatgtgcaggctgagccggtggcgttggtgttgtgctctgagaagattcgcgaggacgccgagcggacgctcgcttggttccgtgagcagggtgtgcgctgtcgtgtgatttccggcgacaatccagtgaccgtgggtgccatcgcccgcagagtgaaactcaccggcgaccatgagccggtggcgatggacgcgcgcgaactgcctgaggacgtgaacgaacttgcctgcgtgctcgaaaacgtcgatgtgctcggccgcgtgctgcccgaccagaagaaggccatagtgcaagcgctgcacacgcagaaccacgtggtggccatgaccggcgacggcgtcaacgacgcgctcgccatcaaggaggcggaccttggcatcgccatgggcaatgcggcacccgccaccaaggccgtggcccaggtggtgctggtggattcgaagttctcgcacctgccggacgtcgtggcgcgaggccgtcaggtcatggccaatatggagcgcgtggccagcctgttcctcgtcaaaaccgtgtactccgcgctgatttcgctcggcgtagtgctgacgcaaatcccatacccatacctgccgcgccatatcacgtatatcggcgctctcaccatcggcatgcccgcgttcattctggcgctcgcgccgaacacgcgccgctatattccgggattcctcaagcgcgtggtcacgttcgcgctgccgggcggcatcgccaccgcgctgtcggtgttgctggcttcatggaccctgccgaacgtcatgggctgggatgtggtgaacaatgacgccgatctgtcggctttgcgcgccaccagcgccattattctgtttttgatgggcgtgtttgtgctggcccgtgtggcgaggccgctcaacagctggcgaggtgcgctggtcgcggggttcgcggcggccggcatcatcggcgcgttcatcccgttcgtggcgaacttcttcgcgctgattctgcctaccggcactgcgttggtggccacgctgattgcgttgggcggcgcggccatgattttcgtgatctgtctatggctggctccgctggtcggcagaatattcggcaatctactgcgccagcacggtttcaatatctaatagcggcgaattgtctcacacttcaagccgacacgccagagccaaagtaacgtacccgtaccatttgtatcggataatcaacggcatcataagccgattcatgatttcggaggaagcatgtccttacgcgacgaccagctggctaccctcaaggcagccggcaaggacttcgattactacaacatcgccaatcttgacggcatcgatcatctgccgtactcgctgaaggtactggtcgagaatctggtacgcaacatcgacggtgccaacatcaccgacgaacacgtcaagaccctgctcgactgggatccgaacgccgaacccagccacgagatccagttcacgccgtcccgcgtgatcatgcaggacttcaccggcgtgccctgcatcgtggacctcgccaccatgcgtgacgcggtcaaggaccttggcggcgacccggaggtcatcaacccgcaggtccagtccgatatggtcatcgaccactctgtgcagatcgacaagtacggcatcgccgacgcggtccagcagaacatggacatcgaataccagcgcaacggtgaacgctaccagttcctgcgctggggtcagcaggcattcaagaacttccgcgtggtgccgccgggaaccggcattatccaccaggtcaacatcgaatacttggccaaggtggtcatgagcaaggccgaggccaacggcaacacgctcgcctacctcgactcctgcgtgggcaccgactcgcacaccaccaccgaaaacggtctgggcgtgctcggctggggcgtcggcggcatcgaggccgaggccgccatgctcggccagccgatctccatgctcgtgccgcgcgtggtcggcttcaagctcaccggctccatcccggagggcgttaccgccaccgatgtggtcctgaccatcaccgacatgctccgcaagcacggcgtggtcggcaagttcgtggaattctacggcgaaggcattgcctccgtgccgctggccaaccgcgccaccatcggcaacatgggccccgagttcggctccacctgcggcatcttcccgattgacaacgtcacgctcgactacctgcgcctgaccggccgctccgaagaacaggtcgcgttggtcgaagcctacgccaaggccaacaagctgtggggcgacgcctccgacccggattacgtggaaccgcagtactccgaatacgaggaactcgacctcggtaccgtggtgccgtccatcgctggcccgaagcgcccgcaggaccgcattctgctctccgaagccaaggagatgttcgagaagaccgctcccgcctacgagaccgagaagaccgtcaaggatccggtggccgtgtccaccgacttccgcggcgatttcgacatcgaaaacggcgacgtggccatcgcctcgatcacctcatgcaccaacacctccaacccgtccgtgatgatcgccgccggcctgatcgcccgcaacgcacatgccaagggccttaagcccaagccttgggtcaagacctcgctggcccccggctcgcaggtcgtggccgactatctgaaggccgccggtctgcaggacgacctcgacgcgctcggctaccagctcgtcggcttcggctgcgccacctgcatcggcaactccggcccgctgctgcccgagatctccgaggcgatcaacgccaacgacctgaccgtcaccgccgtgctctccggcaaccgcaacttcgaaggccgcatcagcccggacgtcaagatgaactatctggcctccccgccgctggtcatcgcctacgcgctcgccggcacgatggacttcgacttcgagacccagccgctcggcaccgacgcggacggcaacgacgtgtacttgaaggacatctggcccaccaatgccgaggtcgccgccgtggtcgacggcagcgtgagccgcgagatgttcctcaaggactacgcctccgtgttcgacggcgaccaccgctggaagggcctcgacgtgccggaaggcgagctgttcgcgtggaacgacaagtccacctatgtgcgcaagcaaaccttcttcgacggcatgaaggccacgccggacccggtcgccgatatccacggcgcccgtgtgctggccctcctgggcgactcggtcaccaccgaccacatctccccggcaggcgcgttcaaggcctccagcccggccggcaagtacctgaccgagcgcggcgtggagccgaagaacttcaactcttacggttctcgccgaggcaaccacgagatcatggtgcgcggcacgttcggcaacatccgtctgcgcaaccagctgctcgcctccgtgggcgaggaggtgacgcctggcggcttcacctacgacttcctcgccaagaagccgaccacgatcttcgaagcctcccgcgactacatcgacaacaaggtgccgctcgtggtgctcgccggcaaggaatacggcaccggctcctcgcgcgactgggccgccaagggcacggtgatgctcggcgtcaaggccgtgatcaccgaaagcttcgagcgcatccaccgctccaacctgatcggcatgggcgtgctgccgctgcagttcccggcaggcgaatcctatgagtccctgggcctcaacggcaccgagacctacgatatcgccggcgtcgagaagctcaacgagggcgtgacccccaagacggtccacgtcaccgccacccacgaggacggctccaagaccgagttcgacgcggtggtccgcatcgacacgcccggtgaggccgactactaccgtaatggcggcatcctccagtacgtgctgcgcaacctcatgaagtaaccaccttcttggctcccctctcttgaggggagctgtcagcgaagctgactgggggagcaaggccggtatccgccaacggataccggccttttccacgcatgccaaaatgctatactgtatagcatcttcgaaatggaggttgccatgaccatggtccaaatgaacgttcgcattgatgcgaaactgaagaacgaggtcgaagaagtcctcaagggcaaaggcgtatcggtgagtgacgtaatccggtcgctgtggttgtacatcgccgaccgcaaggaagtgccggcattggaaacgaccgccgaagagcaagcccgcgaggaggaaaagcagcgcaagctgaaactgattcgagaaggtgccggatacgtacacaaggaactggtcaaggccggactgatctcagaagacaccgacctcatggaaagccttacctacaagcagttccgcgacaaaatgtacgacgagcaacttgatgcgtattacaacatgaagagggccgattgatgaccgacgtttccatgcagcgtattttgctcgataccaacgtactgttggactatttgctccatcgcgatgatcacgccaagatggcggaagcggttatggaacttggcgcgaagaacaacattacgttgttgtgcgcgtcattgtcgctgaaggatatcgcatacctatcatcatcggcgattcgtagggaattcaaaccgaatgaatcggaagtggagaatttcactcgcggctttctgtcgtcacgggtgccatggcgttgtatcgagcaggtgaaggagatgtgtgacatcgtcgctgtcgatgagtcgacatgtgataaggctttttccctgcaaaaacggcatcgggattttgaagatgatctgatcatcgttgccgcgcaacaatccggtgccaactgtgtggtcacatcggatgccgaattaatcagtcattttcccgaatattgcaaaacaccggctgaaatcgtggcggcgctggaataaatgagcgtgtggctcccctcacggagggggagccaccaatgacgtgccggcttactgtagcctactgcgcctgcagacggaactgcttccagatgtcactgagcttctggccgttacgcgtgcgcttccacacgtccagaccgccgccgcgacgtcctccggcggcggcacgggccgcggcggtcggagtcggatattcggagccgtcatccagacggagacgaccgttttcggtgaccgtggcaaaccagcgctcgcccttgcgcggccgctcccacaccagacgttcgcccggcaccagaagacccgcgtcaatcacctgccggatcgtgacgcgccgcgaactatgagacggccgtggagaagtcttcgacaactcatcgacattctgcttggtcagatcgcgggcgtccttgtcataccggatgccccagtattccacgatgagtcggaccgcctcttcctgccgcgcttccagcaatgcgggtgtgcagtcagcgaaatccttcaactgattggtcagcgggaaacgacgcgaatccgcgcgcagcagcatgcggtcgcgacgtgccggatattcactcaacctgtccaactgatcctcagggccctgcaccagcgccatattgccgagtcggtacatccagaaatcatgctgatcctgcggccagtccgcaaacgatttcgaccgttcgatatccaacggcataatcggcagcgcactgaaccggcgtggtcgatccaactgcatgccggccttctgctcgttggcgcgaatcagcagcagacggaccaaatcgccgtcaccctgcatctcgccatgcaaacggaccaatgcgccttcacggtcgccgtccgagacatgcaacccgttcacgcgctggaccaaatagcccttgtcaagatcacggatggcggcgttcgcataaccgcgccgctccaacgctccagtgcgattcagcgtgcggatgccggtcacctgttccaatgcggtcagaatttccagcagccgacgctcgtcatgggcacccaacgattccagcgtggccgtggttctggcgatacgcgaggcacgaaccacaaacggcgacaaatcggcgtcgcccagcccgcgatacgaattgaccaacgcccacatggccacgggcttccactcgtggctgcggtaatcatccaatccctcaagccggctacgcacctcggcgggcagtacggtatcgctggggcgtgcgatgatccgccacgccatcgcgtagggtgccagcacctggttgatgaacgtgggcaccgtgcctttgtcgatgtacggttgcagcacgtcggccaggaaatcctcgatgagcttgtcggtggccggcttgtgcgtgagcacgagatgcagataggcgaagaattcctcacagtcatgcggatcgtcgccaatcgggtcaatgatgtcatcccaacgggcggcgtacacgtcaagttcggcggtcgacaggccggccgtggcgcgcgccttgaacacgtcggacgaggtgagcggcaggccgcgcatgttcatcacgtcgaagatgcgatgcgcgccgtcgagatcgtcggtggtcacgatgaccagcgtcacctcgttgaccagatactgcgcgaattgctggcgttcggcatccgaccaattggaaatctcgtcgtacgtcttacggatgttggctacgatattgcgttgcgctgcggtcgccagatcatcgtcgttcatatcgaacacggattcgagattgtcttcctgcacgtgttcgcggaagaacgctgcgtcgcgctcgcgcaacgtgaggcgaggctcggtgacgatgccgcgcagcttgtcgccgggctccaccagcagcgcatcgagttggcgcatgaggtccgggtcgcgctccagatcgcgcaacacggcgatgatgatcgacagggataccagccgctgctgcccgtcgattacgtcgtaacggttatcgccctcgcgcaccagaattagcgagccgaggaagtacggagtaccgggcgacttgcaggcgtcatccaagtcgcttaccagttgcaggatgttctcggtcttccagatgtaggcccgctggaatgaggggatcgtgaaccggaaatccggggtgaacactttcccgagtggtagttccttcgcactgattgccatgtcagccccttcgtcgccggcctgtggacggtatgccggcataccaacttgtgctcaagcctaccagtgtttgcccgacggcgggcacatcacgccggctcgggcaccgacccctcatacaagtagaacgaagacgggttttctcccggcacggatgcgggcagtgactgctcgcacacctgcgtcaggccgcgatgcacatagaacccgacatcgcatgtggtgtccgtgaacaggaagtagtcgcgcacgccggccaggcggaacgcgtccatcagcgtctcgaacatgcgccggcccagcccgtggccgcgcgccgccgggtcaagtacgaacagcaccacttccgccgcatagtcatgcccggcgctcgcggcctgggcgcgcagccgtttgtcgatgccgagaatgcccagaatctcgccggcggccttgattccgcccttcgcgaacacgagccgcgccagcgcgttccacgagttgatccgatgcgagttgagcgggctccgatggtccagcgcatcgacgcgccccacgatcagggcgaccggctggccgtccagttcggcgacgaacgcgttggtggtgcgcgccagacagttctcccagtccgcttcggccgccagcagaccggtccgctcatcgaattcggcataccaggtgcggcgcaccaggtcgatcagcgccggatagtcatccctacgtaatgttcgaataatcgcttcactcatattcccattatgactgatacggctcaacaaccggacgacttacagccgcgccggcagatcggcccgctccaccagccgcgccatctgcacgcggcccatgtcgagcttgttcgccgcggaagaaagatgcgccttcgccgtacgctccgaaatgaacatgcgggaggcgatttcggcgttcgtatagccctcggccgccagcatcacggcctcgcgctcgcggtcgggcagcgcgtcgagcagggcgcgcgcctcatcgcggcgcgaacgcggccgcgtgacgctcagatcgtcgatcagctgtttctgactggccgtgttgaactgcggcgcgccctcgcataccccgatgatgcggcggatgatatcgtccgccgcatcggttttcgacacgaacccctcggcgcccgcctccaccgcgcgttccacggtgccggacggactcaacgaggtcaggatcagcacgtgcggcgcgggggagagcgagcgcagcagacgggtcgcctcgatgccgtccacgccgggcatggcgatgtccatcagcaccacatccggcttttcctcggcagcccgcctcacgcaggtctcgccatcggtggacgtggagacgacttcgatgcgcccgtgagaataatcgttgaggatcaggctcatcgcctggcagatcatcggatcgtcatcgatgacgctgacccggatcggcttgggctctaagccggtgccgcttccggtcagaccgccgcgttcgggctttccaccagacacactattcccgttcttctcactcacgctagccatcttagctgcgccaaggcagttgcacgtcgacatggaacaggtgccgatcgtccatcccataccggcattgcccgttgaccgagtgcacgcgcgctgccaaaccaggcagtccggccccatgggcccgctgcgtctcggtcgcatccgtggcgatcggattgctgatatggatatgtacgcccgcctgcggcgtggcggagacctccaacgacaccggcgctccgggcgcgtgccgccgcgcgttcgtcaatccctcctggatcgcgcggtaggccaccttgccgattgactcatccatcacgctcagctgctggatatcgatccaggtgttgagcgacgtgcccgagttgcgcgtgtccgcaatcagcgcatccagcgattcgcgggtcagcgacgtgtcgtcggacggggcgagctgctcccatgcctggtgcgggttgcgcagcatgtcgatgatcgagtgggcctcgtccaatgccccggccgactgccgacggatgtcctcggccttatccgccaacgattgcgcttcgggggagtcgccgagcttggccgcctccgccttgagcgcgctggcgttcagggccatcagggacagggaatgcgcgagggtgtcgtgcgcttcggctgcgatggcgtcggcgagctgctggttggtcaggtcggtctgcagggtcgcggcatgcgtggtggccgcgctggccaccgcattcgccgtgcgcaggcgggcgcgcgaacggatatgcaggccgatgagcgtagcgatggtcacgaacaccagtgaggccaccgtggcggtgatgatgacggtcggctcctccaccagcatcaccatcggggagcctgaatcgccgccggtatgcggttgagcgaaaatcagatgccaaatcgaggctttgggctgttgcagggcgtcgcggagctgggagatgagcgtcacgatggtgccgccaaccgtggcgcggatggtcgtgttccggtttgaacgacgggcgagcaatgaggtcatcgccatcagtgcgatgagcgagtcatacgggaacacgaccaccagcgcgcaggcgatccagaacgtcgcctccgggtattcgctgcgggccaagagcaggaaccctgccgggaatgccagcaaggtgcagaggaccatcagcgtgtatcctgcggaatcctgcgcaaaattctgggcgaagaacgaggtttgcgccatgcacatgaaactggccaatggcaccataacgaccgaacaccatacgcgcgtagtcacgggcacctcgtccgtatccggtgtaggaaccggggaccccgtgccgggcatagggcgagcgtcaggccgtgagccgggtcggaaaccggggtatggcccggcggcgcgttgtgggttcgtcatgctttccactgtatgacctgcatccggcccccgccactggacatgcgggcaccgttatcacctccgtattgcccgaacaggcaacgaacaatgaccgttcgtccactaacgtcgctgtttcgcggccggtagcgtcgtgctcacatccctatttcggggaagatacgagaaggagcacatcatgtccaaccacaacatcgccccgcagccggttccctcatccccacagcagtaccagccacaacagcctcagcctcagccgccgcaaccgcaacatctgcataccaccatctgcggcatcgcggccgtggtgtttggcgcgttgggtttggtgctgagttttattcccatcgtcaacaatatcgccgcaatccttggcttcatcggcgtcatactggcgattatcgccatagtgggcaccttccggggcaagaaacgcggcaaggtgctgtccattgtggcggcggtgctgtcggtgttggccattgtgatcacgctggccatgcagtccgctgccagcaaggccattgacgattccattaaggagtccaagggcatcgacacgtcacaatcctcatcatcaaagtccgcaggcaaatcgtctgatgcctccaaaagcaaggcatccgagcagaaagcgcagggcgagcaggatttggaaggtgatatcgaaggtgcccacgtgaaaatagtctccgccgtgaaaagcgtcaacgactataacggcaagcccaccgctctggtgacttatgaatggacgaacaacacgtccaagaacaactcgttcgccactttggctcacccgaacgtgttccagaacggcaccgaactggagacggcagtatacttcgatcagcctgaaggctatgacgcgaattcgtatttggcccaagcacagcccgggaccgcggcaacggtgacgctgggctatgtgctgcaagacgattcgccgattacggtggatgtcactgcgttcctatcaacggatcaagacaccaaggtgacgcataccttcacgttgcagtgaatcgcgcggcggtccaagctgcgatcgaatgtcaatcgaatctcaagtgcatgccacgcgcatggtggaaacgcccgttacgctttgagatgagcagaacgagccgatcgatcatattcatggaatgttcagctttgttcctctaagattggtactggaacaaacgctaaaggagcgattatgacattcggtcagcagccccagaacaacgggcaatacaacccgcaatacaacacgcctgattacaacgccgcccaacagtctggatatggccagcaatacgcacagtccggttacggccagaactactatgcccagccgcagggcgctcccacctaccaatacgtgccgcagggtactggtgccggtgcgggtgcggccaccatcaacacgacgatgacctacaactatgaggaagcccgccgagtctcagtgaccaaggtgtacggcgagatgaccatcggcatcctcgtcaccgccgtggtcgccgtgctcggccagatcactggagcctactacagcttcctcatggccaccggcatggtgggcctcatcggcctgtgcgtggtgcagattgccctggccgtggtgctcggcatgcgcgtcaccaagatgaagtcggccaccgcgcgcgtcatgttctatgtgtacgccgcattgatgggcttcaccttgagctcgatcttcatggtctacgacctcggctcgatcggcgtggcactcggtgtcaccgccgcgttcttctttgcgctgaccatgttcggcatgactaccaagttcaacatgctcaaggccggcccgatcctgatgatcggcctgattgtgctcatcatctcgcagatcgtgctcgccttcgtgcaggtcgacggcatgaccaagatcgtctgcgccatcggcctgatcctgttcgccggcatgaccatctacgacgccccattcataccaaggcagcgcggcacggcgtcctcgtccatgtgaatggcctgcaggttaatgagcctatccacgccggcagtgcgctccattgcctcgaccaccaggtcgcgggtgctgtggtcaagcgattcgcccaccagcagcgaaccggacttaaacgccaacgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaagcggagggctgcggggtggtgaccaccacgagttcggcgttgggcagcgcctgggccacggaaatcgccatgtcgccggtgccgggagccaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaaaccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgcgcccggataggagctgaccgcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccaagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagccccctcatcagagggggttaatgaagcgtctgagggggctattttagagggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaacgaaccggtgaccaccacggttttgccggccagcgtctgcggcaacgaactggtctcggcctcgtcgacgcccacgccggcggcctgccaagcacgcaaagtcgcgccgcgccagtcgccgggctcgcgggtggcggcgaaccagttcaccaccgattcggcgatttccgggcccaccccgtcgatggccgtcagatcttcaatcgtggcgttttcgatggctgccagcgaacccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggagcctcagccccggtaggtgcgccggtcgtctcgctggcggtatctccctgtgtttcggcagattcgattgcggcctccccttgcgcgcgttcggccagctgcttggccgtgagctttttggccggcgtgggcgcggtccagaaggcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttggacaacaccggcttctgcgcggccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtcaccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacacggccggtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacatcatgggtgccgcgcggatggtccggcccccaagtgagctgccccagaccatgcgcatagaagctcaggcgacgggtggcggtgatgcgagggtctttttgacgcagcgagccggcggcggcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgccggtaacgccatcgccgcgcgtcaggccctgttcaagcacgccgttgcgatagatgaggttcagggcgaggccgtcgattttgacctcgcagctcatgggcaggggcttggattcgggccaatcgaggtcgcgaatcaccgagtcgtaccaatccttgagttcttcgatggagaagacgtcgtcaaggctcatcatgcggctggggtggcgcacggaggcgaagtcgttggagaaggaaccgccgacgcgatgggtgggcgactgcggattgtccagtgaggggaacgccgcttcgagtcgttcgaggcaacgcatgcgcgcatcgtaagcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgccctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagtgaaccaatggccccgggagcgatgtgatcgctcataatgtaggctgcggcggctgtgtcgaaccggtcaagcatccattcggcgtacgcgaaccggtaataggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatggccgcctcggcacccttgatctgactcaacacgtcagccagctccatgtgcgcgtagaacagattgtccgggataagcaccgtacgctcgtccaatgtggcgaacagccggttgtagaccacgcgctcggcataggagttaaagtatcgaggtacgccatggcctgccgcatacacctggtccaaatgggccacggccgcttcggccgcttcgatggcctgatcggcttggcccgagaacagcatatctcgggcgcgcagacgctccttgtcaagatcgtcggcaagcgtgaacgtgaagtccggcgtgtccttgccatcgatcaacgcactggtgacctgagaggccaaaccggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccggactgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacactcatcggatcatcgtccatgccggcggccccatcagcaccgtcagtgccgacgccctcgccgccgataccgcccaggtcgtcgcctgcgccagtatcgtccggcatgccgaacgccatttcgtcgatatcgatgcccttcatcaggtcttcgaactgcgaatcgatggacgcagcgccatcggcgtcagcagattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaacttagcgcggccatcatcaggccgacacgcaggttgtaggcagcgctcattgacgcgcgttcggcgctactcagcgcacgccacgtacgtcgagtggtgtcataccggctatcgggcatcatcgaggtgccggcggtggtgaagccaatggccacttcacccgaatccaagcgcgaccggaactccacgtcaaaccgatacggcaaccgtaaccggcgcaacagtgaagagagggtctgacgatacacccattcgtcgctcctcgccggcgaatacgaaggacgagcggcttgagtgttggtgtcgctcttatcggtccgttctacagcgccctcagcactctcagtactttcagcgcccgcagcattcgtcacacccgaatccggcacgttctgctgggtcagcacatctcgaggatcggggaattcactgcgaatctgtccagccgtgcgtgcggcgatatcgaccaggctcagcacggcccgacgctcctgctcgccatcatacgggtcaagcgccataatcgcagggttttcgatgagtttcatgtcgatttgcgcggcctcggcacgggtcaccgtatcttccgtagggttgcgtcccaaggaagcgttgcgctccaaccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaacggttcggcgccatgcaccgcttccagtcccggcgtggtgtcgagggcgccggcttcgcgcatcagatcggcgaaatgatcctccagaccggaggcccgcatgccgtgggcacgtgccgccaaagtgtcacgcaccgaacgtcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcgcaggcggcagattggcacgcatctgctcaagcgtgtaccggttgccggccttgagccatgaggcgagccacgtcatgcgtccggtgtcgtcacgccccaccacgccaccggtaatggccttcacaccgtcagcaccatgaccaaggccacgccccaaaccacgcccatgatgcagcgcacttcccaagccacggcctgcacaggagaaaccggaacgtgaacgcggctcgtcgctttcgcccagccgctcaccgtccggcaaagtcacttctttttccttgccgaacatgaatcgcgcctgcatatcctgcacgtccatgtcggtgtcggtgcccacgaatacgcggccatgcgtatcggcgaacgccacctgcgcaaaatgatcgcggtcggggaaaatgccaagcgagaagccgcggcctctggtggagggcagctgcgcccatccaagcaccagcccttccggcacgttctccaattcagggaaggtgcgtcgcttgattacagggctcagcgccactgcatggcgagtcagttcgtcgataatgccgcctttacgctcactggtctcctgcaaggcatcgccgaacggattcgtatcgtgcttcttcggcttggacagtcccagatcggccgcgagcgcgttcatcgaatccttcagtccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagactgtccgatgccgtcgaatcatgaacggcgcctgcccagccgtccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgcgagcagcaaggtcatcgataaggcccgtgagcaggccgaggccgaatccgaagcgaacgacgataaggaagtcttcaaaccgctggcgaccattcatgtgcgcgcggatgtcgatggcatcaccggccaggcccagtcgatgaatcccgacgctattcgcagccattatgtcaaggcaccgggtgccggcatcgtgcgtatttggattcaggaagagcgcggcgcgatcgtaccggtcaccgactcccgcgccaacgtgcgcgtaccgttcgtcatcaattggatgcgcgtgctcgccatggccttggtgttgctgatgattgccgtctggaggccgagatcgcgcctgtggcgtatcacgcttgacccgtccagcactcggcaacgacttgctttcgtggggcttatggcgattcctaccctgcttatcggcgcatccatcatccacgaactgtggtacgcgtctccgctcgtcttccacgtttccggcgattacacctatgatttcgaccagtatgggcatgtggccgatgcgctggtcgccggccggccctggctcgacttgccggttcccgaacaactggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctgaccggtcataatctgccgacatccgccgccgagtatattctcgtgctgctgttcatcatcttcttctccttgctggtgctgcgcgtcatccatcgcgtgatgccgaagacttcggtggcggccgcgtcgttagtagtggtctcatcgttggtgagcgcgcaagtggggtatttgctgtatcgcacgaacttctatcagataccgttcgccgcatcgctgacgttgacttcgctgggactatggctatggctcggcgcggacacgtcccgccgtccgctgagaccatcggaccgatggcaggcgggcgacgccaagcctctctccctgccacgactggccttgggtgccttgtgcattgcggcgaatttcggatgccggccgacgttcaccttgaccgcattgcttgcgttccccctgttctggccgcagattcgcgcgctgggcaccggtctgcgcacacgccgtatcaagccgttgcaggcgttgcgcgcgccgctggcggtaatcatccccgccattctcgtcgtgacgcctctgatgacgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttccagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacctcaaggcacagtacaagatggtgctcagttcgggatacatctaccgcgtctaccagtacggcttccgcggcttctacttcgcgtgagccttggcatcggcctcacggccgatgccaatccccaacggccgattcctatctgctaccgcttcgcagcctcatacttgcggcgaatcagatcctcataaaacgccacagcctcagccggcgctccgtcaaacgcgaccgcgtgctcatccagcaccagtacacggtcgatggcgtattcgggccggcggatcatatccgtgtcatgcgtggcgaaaatcacctgcttgttgtagctgaacaacgccttggccacatgcgcggtgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaactttgccgaccagattatcgatgcgcttcgcttccttcttcacagccgggtcaagacgttcctcaccgcccgcaatggtcaccgtgccggcgttggccttcaacgaaccgtccagcagacccagcaatgtggatttgcctgcgccgttcagtccgatcacggccacccgccgctcgctgatggtgatgtccgtgggagcaagtcccacgtgcccatcatcatacgtatgcccggcctgatccaaagtgaacgtcagcgatgccgggcgtggcagttctttcggtctaaacaagaatcccatgccgctattgtacgtggagtacaggtgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagcttatgctcgtcaatcagccgcaacaccagctcgttctcatcgatgactgaaggcactcgtagcagcacgttccagccgccttcggcccgtagcacgctgatcagcccgttgggatcggcgtcaagcaactcgtgcaacttggctaggttattgcgcacgcgctcccccacccatttggtctgtgcaggcgcggcgttcaataatgcgggaatccgttcggcaatgatgtcactcatcggcagataatcgtcggcgatgacgtccagtcgacgctgtgcctcggcaacgtcctcgtcgggtccagatacctgaatccacccgactttggcgtgcggcgcggccagcattttggagaatccgtctagggcgaaggtgagcacgccgcgctcccccgcgagccgtgcgttgccggggaaaggttcgagaaagtaatcgaagaacacttcatcggcgataagggcgatgccatgttcacggcacaatgtcacgatacgtgcacgctcggttggttttacgtacgaaccggtcggattgttcgggttgatgagtaccaatgctctgacgcgttcgccaccgggctcgctgagcagccgctcgagttcggcgatgtcgatgaaccaggagccgtcgaattgcaactggtattcgaccgtgtcgacgcattcaagccgtgcaatcgactcgatcagcggatagccgggtttgggtgccagcaccgcgtcgccggcatcgcaaagtaacttgatcagccacgaatacgcctcggacgtggagctcagcaagtacaggacgtccgggtcaacgccctcgatggcggtattcgcattgttgaaagcggcatggcgctcgttcccgccctcgatggcggcgggcgaagccaactgagggctgcttgcgtctaccacgtttgccgtattgaggaatgcggccaatgcttctcgtgccgcacgcggtccacgtgggtcggccgtatacacgctcggcaccaattcgggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcggcacattcccgggaatgcgtcgccacagacctccatacacgctcactttgcgcaactttccggtgacctccgccgtgacagggcggcgctctaaccaactgagctacggggccatctgtacctcaatgaagcacaagaggatatactacagcatcactggaccacggcgcgccgcccggcgcgtcgcgccacggcaatgtcaggcccatccattacccctccaagccatagcgacgcccgccattccagcccttccgataccatggtgggcggtggtttggcgtggattcgatcgttatgcggacagggcggcacaggcctgacgcggcgcaccgcgatccgtaattcggggggcgtgctccgcgctgcacacagcgtatccatcacaaactaaagactaaagaaacagcggaattccaacccctttttaaggagtaactgcacaacatggcagaattcgtatttcagatgatcaaggcccgcaagtcttacggcgaccgcgtgattctcgatgacgtgaccctgagcttcctgcccggcgcaaagatcggcgtcgtgggcccgaacggcatgggtaagtccaccctgctcaagatcatggccggcctggagaccgtgagcaacggcgaggccagcctgaccccgggcttcacggtcggcatcctgcagcaggagccgccgctggacgacaccaagaccgtgggcgagaacatcaagatggcgttcggcccgattgccgagaaggtcgcccgattcaatgaaatcggtgaggagatggccaatccggacgccgacttcgacgccctgatggaagagatgggcaagctgcagaccgagatcgacgccgccgacggctgggacctcgactcccagctcgagcaggcaatggacgccctgcagtgcccggacccggacaccccggtcaacgtgtgctccggtggcgagcgccgccgtgtggccctgtgcaagctgctgcttgaggccccggacctgctgctgctcgacgagcccaccaaccacctggacgccgagtccatcctgtggctggaacagttcctgcaccagtacaagggcgcagtcatcgccgtcacccacgatcgttacttcatggacaatgtggccgaatggatttgcgaggtcgaccgcggccacctgtacccgtacaagggcaactactccacctacttggagaccaaggccaagcgtctggagatccagggagccaaggacgccaagctcgccaagcgactgaagaacgagctcgactgggtgcgctcctcccccaaggcccgtcaggccaagaacaaggcccgtctggagcgttacgaccagatggaaaacgaggcacgcaacaacaagaagctcgacttctccgagattcagattccggccggcccgcgcctgggttccaccgtgctggaagccaaccacatccacaaggccttcggcgagcgcgtgctcatcgacgacctgtccttcacgctgccgcgcaacggcatcgtcggcgtaatcggcccgaacggcgtgggtaagtccacgctgttcaagaccatcgtgggcctggaaccgctgaccagcggcgagctgaagatcggcgacaccgtcaaaatcagctacgtggaccagaaccgtgagggcctggacccgaacaagaacctgtgggaagccgtgtccggcggcctcgacttcatcgaggtggccggcgtggaagtgccgacccgcgcctacgtggccagcttcggcttcaagggcgccgaccagcagaagctgaccggcgtgctgtccggtggtgaacgcaaccgtctgaacctggccctgaccctgaagcagggcggcaacctgctgctgctcgacgagcccaccaacgatctggacgtcgagaccctggaatccctcgaaaacgcactgctcgaattccctggctgcgctgtggtgatctcccacgaccgttggttcctcgaccgtgtcgccacgcatatcctcgcgtgggaaggcgacgacgacaacccggccaagtggtactggttcgaaggcaacttccaggcctaccaggagaacaaggtgacacgcctcggcgaggatgcggcccgcccgcaccgcctgcacaagaagcttgtgcgcggctgagatacgccggcattagtgccacaacgcgctttatacgtcgaaagccgtccctcaggggcggctttccccataattgccccatggctgcccgccccgcatcccataaaatcccacagtcacctacggcaacacaccggcaacacaccggcagtgcagcagcaacgtagcggcaatgcgccgcataacccaccgtttaccttccaaacagtctcgttacatttcgctcccggaactcttaacccccaccggatagactgccaaccataggttggaatacgataaccgaatactgaacacagcagaacaagaatcgaggaacgccatggctcaggcaaccaccgtaactccattggaccatctggtgaaggtgctgaagttgggcgagccttccgcttaccgcaatcacacgtatatcaatggcgagagtatgtacttccccaccggccgcgtctacggtggccaggtcatcgcccagtcggtgatcgccgcgtccaaaacagtgggcccttcacgcctgccgcattcggtacatggctatttcattgccgccggcgatattcgtcaagacctgttgtttgacgtcgagaaccttcgcgacggccgctcgttctccgctcgtcgggtcaacgtcacccaagccgaggggtcgattctcacggccatcgcctctttccaggagaccggccaagagggtgtggaatttgccgatccgatgccggaaaacctgcccgatcccgaaacgttgacttccgccaaagaactcatgcagccgttcgccgagaagtcgccgttcgccaattactatgccgagaaatcgccgttcgatatccgccacgtgacgccgaccgtgatgctgcgcgcggacaaggattccgccgagcatgattccggcaagcagatggtgtggatgaaggccgatggccacgtcgatgtgccgcaggtcatgcatcgtgcgatgctggcgcttggctgcgatcaggtgatgatggagccggtgctgcgccgcgccggactgtcgatttccacaccgggcatttcctatgcgtccatcgaccattcgatgtggtggtatcaggatatcgatatcaacgaatggcatttgtatgtgcaggatacgcctatcgccgcgcacggacgcggactcggcattgccaaagtgtatgcgcagaatggcgacttggtggcggccatcgctcaggaagctatggtgcgcgtgccgtaggaatagtcacccctaccgcttgtaggcttgggctatgtcgctacggcgcttggcttccctgattttcgggttttcggggccttcgttcggcggtagctggcacaaccattcgccgataatgccgatgatcatgtcggcgatgcacaccacggccgcaattgcgcactcggtgacggcgtgtgcatagaaatccgcctcgatatggctcaagctcaccacaatctgaccgccataccagccggcgagcgttgcgcccgccaatcccagtgcctttgccaacaccagcgtatacaccgcgatagtgggattgatgaagctatgcggacgtttcttggggtcggtattcgcgtatttatgcacttgcagggccaagatcagcacaataacgcccagtacggccagcaatccgggcacaatccaaggcgcaccaatcagcgacagtcccgagctttcgccgtaggaggccagaccgatacccgccaacaggcccaacacggcaccgatcacatactgccaccatggtgttcgccgtgttttcatgtccggcctccttatcgttgcgttgctgtttgctgtttgcgaacggccttcgcgctttggccgttcatcttgatttgttttttcgtcattgccgtgcctggctgctcgaggccggagactggtccgtcaccgtctggtttctagcctaccgttcgtaactggttctgccatcagcccaactgttcgacagtatccagttgtccgatagcaatccgacctgtccggcatccggtgccatggccaaaaggaaggccaccgggtcgccgcccagagaagcattcgggtccatatccagccaaggtgccaataccgacgcatggttacgggccgacggccaaggaatgctgcagttgggctcgtcggaagtcacgccttccatgtcaacaaggtcaaggtcgactgccaggtcatgaacgctttcgatgctgcccaatacggcaatcaggtcggcgggcggcaacttggtttcgatttggatgaccgcgctcatcgcgtccggactgtcgaaatggctgacatggtagagcggcgagatgccctgtacctgattgccaggaacactgtcgatggaaacgatggtttcgcggaacagccgttcggcatcctgcgaggtggaatccagcgaaataatcgccttgcgtgagacgggttccgactccgacgctgattcttgcttgactgcatgcccgccgagcatccagtcttcgctctcgagctgcacggcgttacggtccggcgcggcggccagcaaatcggctacaggcccctcatgggctccagcaagtttggcgttcggattcagcgccgcccagggagccagcacaaatgcgcgctgccaagcacgcggatggggcaatgccagatccggatccgcgctggtgatgccatcaaagtcgataatgtccaagtccaacggcctggaatcccaatgattctcacgaattcgcccatggttcgcttcgatgttttgcaacgcggcgagcaattcgtggctgcccattgtggttccaagctccaccacggcgttcaggaaatccggcgtaccgtcagccatgccccacgcggccgtgcggtaaagcggcgaaataccggtcacctgtgtgccaggcaacgcgtcaatctcccgaacggcggctcgcaaggtggattccacctcgcccacattgccccccaaggccaccaccgcgttatggatggcatgcttttcagcagtgcgtccattatcggtggcacgcacgcgcgagatggagaccgatacatctgcaaaagccacgacgatgggcgcgtgaggcttgtgcacggtgacgtcgatggaggcgacggccggcgcatcggcaagaatcttatccgcgatacgttgggccagacgctcgatcaggtccacatgagggccttcgatgacagccacgatatccttggccacgcggccgtaatcgatggtgtcattgagatcgtcggattggccggcggcggccagatcaaggtgcagggtgacgtccacgacgaaggtttgtggccgttcgtgttcaaaggtgagcacaccgtgggtgccgttggcatgtacgccggtaagtgtgatggtgtccattggtaaggctttctgttcaaatgctccccctcagtcgccttcggcgccagctcccctcgcccgaggggagccaagacctagaagcaaccaaaaacagggagccaggggaatcatgcgtattcgcgccaggtgttgccggcgatgacggcggcgcggcttttggccacatcgtgtacgcgcacggcccatgcgccgtgctcggcggacagggcggacaaggctgcggtcacgtcatcgcgctgggccatgatcgggccatcagcaccggcagtacccgccccggtaagcatcgccgaaatgaagcgcttgcgggactggccaatcagcaccggatatccagtggcgcggaaggtctcgagcccggtcagcagcggtaggttatgctcgatgccgggcttggagaagcccagaccaggatcgatgataatgcgctcaggctttacgccggcggccagcacgccgtcgacttggcgcatgagttcgtcgtgcacgtcggtcaatacgccatgctcgtatacggaggtgtcttgatcggggttcgcgcccttggagccgacgagccagccgcgccaatgctgcacgatgtacaggcagtcgtggtcggcgaccacatgcggcagctcggcgtccagcgtgccgccggaaacatcgttgatgatctgtgcgccctcgctcagcgcggcggcggccacggatgcgcgcgtggtgtcgatggacagtacggcaccggccggaatcaatgtcttgacggcaccggtgatgcggaccaattcgtcggcctcggacacgcgcttggcgccggggcgcgtggattcggcgccgatgtcgatgatgtccgcgccggcggccatcatgtcgcgcccgtgctgggccgccttggccgggtccagccacaggccgccgtccgagaacgagtcctcggtgatgttgagcacacccatcaccatggtgtgcgtactgtcatgcaacgcctgcaaatcagtcattatgtttccccttctatgtaggtcccaagtgagctccctatgatgagggagcttagtagacactatttatccaaaatgaggctcatggcttcggctcgagtggccggattgcgtagcagaccgcgcaccgcagaggtcaccgtgcgggcggaagacttcttgatgccgcgcatcgacatgcacaggtgctcgcattcggtcaccacaatcacaccacgtgcgcccgcatactcgaccagcgcgtcggcgatctgctgggtcaaacgctcctgcacctgcggccggcgagcatacacctcaaccagtcgggcgagcttgctcagccccatcaccccatccttggcgggaatgtagcccacatgggccacgccatggaaaggcagcaggtgatgctcgcacaccgaatacagttcgatgtccttgaccagcaccagctcgtcagtgtccacgtcgaagtgcttctccagcacatcggccggggaagcctgcagaccggcgaacagctcgcggcacgcgcgggcgatacggtcaggtgtttccaccagcccctcgcgctcgggatcctcgccaatcgacttcaggaacaggcgtacggcctcgcgcacgccttcctcgtcgtatgtgcgtttctcccgctggcaagactctatatattcgttcatctcatctctcccttgtcattgtccacaacgacgtcggcccggcctgcgtacgtgagaaaccacatgaacaggtcgggccgaatcgtcatcgtgtctactcttccggcttcatgccgaccaagcgcttgaggctttcgggaatctccaccggcggcttgtccgagtcggggcggcggtcgttggacagccacaccggacgaaccggagccttcttgatcggcgcgaagatcgccgcaagttccttctcgttcagggtctccttgaccaacagctggcggaccagctcgtcaaggatctcgcggttgtcgttgatgatggtccacgcctcggtgtgcgcggtctccaccagcttgagcacctcgtcatcgattacttcagcagtacgatcggagtacttgcgcggctgcagaccatccatcacagtggtctgatcgtcgtcggaaccccacttgatggcgccgagcttatcggagaagccgtattcgatcaccatcgtacgggcgatgctcgtagccttctcgatatcgttcgaagcaccggtagtcgggtcgtggaagacgatttcctcggcggtgcggccacccatcgcgtaggccatctggtcgagcagctggttgcgcgactgcgagtagcggtcggaggtcggcatgacggcggtgtagccgagggcgcggcctcgcggcagaatcgtcaccttggtcaccggatcggtgttgttcaaggcggcggccaccagcgcatggccaccctcgtggtatgcggtgttgcgcagctcttccagagccatgcccttagacttgcgcttcgggccggtctgaacgcggtcgatggcctcgtcgatggcgcggttgtcgatcaactgggcaccggcacgggcgcacagcaacgcggcttcgttgagcacgttggccaaatcggcaccggtgaagcccggcgtgcgcacggcgaccatatgcaggtcgacgtccggtacgaacggcttgcccttggcgtgcaccctcagaattgcctcacggccttccagatcaggcgcggccacacctacctgacggtcgaatcgacccggacgcagcagagcggggtcaagcacgtcagggcggttggtggcggcgatgatgatgaggttggtgtcgttgtcgaaaccgtccatctcgacgagcagctggttcagcgtctgctcgcgctcgtcgtggccaccgcccataccggagccacgcttgcgacccacggcatcgatctcatcgatgaagatgatggcgggagcgttcttcttggcctcatcgaacaggtcacgcacacgggaggcaccgagaccgacgaacatctcgacgaagtcggagccggccatcgagtagaacggcacgccggcctcacctgcgatggctcgggccagcaacgtcttacccgtgccgggagggccgtacagcagcacgccgcgcgggatgcgcgcacccagcgccttgtacttggacggatccttgaggaagtccttgatttcctcgacttcggccatggcctcgtcttcaccggccacatcggcgaacttggtggtgggggtctggccctcgagcagcttgccgctgttcttcttgccgcccatgccgagcatgccgccggcaccgcccatgcggctcatcagccaccagaacaaggcaaggatgatgacgaacggcagaatcgaggtgatgaggtagctcatcacactggtctgctcgatattcgaggtccagcccttttcgagatcgccgttctccacggccttggccacctgtgcgccctgggcgaaggtgtagtagaactgcacgttcttgccgtagttggtcaccttgccggtgtcggcgttcttcttggtgtagtcattcttcagctcaaggcggacgacctgcttgttgtccgtgatctcggcgtatgtggccttgccctgattgatcagcgcgaaaccatctttagtatcgatggttttggtgccaccgccggcgaacatctggaacatcagcacaaccatgaccacgagcacggcaccccacagccagggggactgccatatcgggcggttctctttgttgcctttgccattgttcccgttattgccatggttgaacgggttggtgaacgggttgccgttgttacggttgttgttcgggttcgggttattgccgttacccggcccttgcgggaagctcatgcttgcactccttggtagacggacggcttgaggaccgcgatcgaatcgaggttgcggtagcgttcgtcaaagtcgaggccgaagccgacgacgaactcgtccggaatctcatagccggcgtacttcacgtcaacgtccacctctcggcgggaaggcttgctcagcaaagcgaagacttccacggaagcggcaccacgacgtttcagttctgcgaccagccacgcgagcgtgcgtcctgaatcaacaatatcctccacaatcaaaatgtgccgtccgcgaacatcggcggacaaatcctgcctgactgtgacctcaccgctcgacactgtgcccgagccatagctcgacaggctcatgaaatcgatctgtacaggaatgctcatggcctgggtgaacgcgaccagcgtattcacggcccctttcagcaccgcaacgagcagcggattcttatcgcggtaatcctcgctcgcgagagcagccatctcgtggatcttggcatcgatctgttctttgctgaccagctcgtggtcaatatcttcctcaacgtcagcgattcgcatgcgctccatcttggcacacgcgaatgacgtgtttcttgcgattggctgaataacctctgggaagtgagacgccgccttgcccatgccaatcgacgaccagccggtcgatggcggcaatctgggcagcactggcgttcacaccggcttggctcagcgcgtgagcgatgacccgcaaccgaatcgcctctggctcacgtgcaatacgtttgacgctgatcatcaggccgatgccatggctcgaatcgttggtatcgcctgccacacaggctcgtggcgcatcggtcgataccgctgccgacgatgccggccaatcaactgccgcaaccgcctcccccatcacctcgtcggatcgctgatccagatactccttatccattctggccaaccgtgcgctttcggcgaaatggcgggtgacattgaatccagcgaatcgttcgatggccggcagcaggtcgtgacgcacccgcgagcgcaacggatagtcgtccggcaactcgccgtctaccgcatcgccattggtggggtcatcccaatattccacacccaagtcttcacagaggccggtggtttcgtctcgagtaagggtcagcagcggccgcgcaaaagtcacgccactgcgtgtgaagacctgcggcatgccggccaacgcatccacgccacggctgcgcagcagtccgatcaatacggtttccgcctgatcgtccatagtgtgggccaacagcacggcaatggcacctgattcacgcgccgcggcgcacagctcgttgtaccgggcctgccgcgcggccgcttcgaggccctcaccgcgtgcctgcacggttgcgttgcgcacgatgaccgggcccagtcccaacgcacggcaacgattcgcagcctcgccggcgacctgttcggaaccctcctgcaagccgtgatccacaatcacggcaccgcaacgcacgcccatggacgtgcatacgatatggctcaccgcggccagcgccatcgaatcgcgcccgcctgaacaggccacgagcacgagcggcgcatcggcggcaacggcatggtccccatgctgcgcgaattcgggagcctgcacatcgcatagttccacggcgctcagcgttgcgcggaccgcgcctacggccttgcgcaatcgtgcggaatatgccatgtactcaccaccctttttctggttatgtgtactcgtgcgtttatggacgtttacggcctttgtagcccttgatggcccctgatgggtcttttacagccccgcgagcttggtgatgaacgagtcgatggcgctacgcgcggcggcataatcctcaggattgttgaccaccacggcaaacgacaacgctcccccattggtacgggacacattgccggccatcgacgtgaccgtgccgaggctgccggttttgacgcgcagcagaccggccacggcatcatccgtataccgatcctgcgccgtgcccaccaaccccgcgatggatagaccttccgcaccagcagcaccgctctcggtggtcagattacgttgttggacggccgccagcgtgcgtacggtgagccgggagccgggagacaggccggagcaatcggccatggtcagaccggatgtatcgagaccgagatcgttcagagtggatttgaccgtttccgtgccgccttcaggactgtttgtcgctgatttcgccaaggcggtgagtctaccgaactcctcggccagcgtattgtccgaatgccgcaacgtgtatgccatgatttcggacagtgttgccgaactcaccgaggccaaaggcgtttcgccggatggagcggtgtttgccgtcacgtctccggtaacggccacaccgttcgattggagcagttcggcgaatttcgtggccacgtcgctggcggtgtgctgggacagttccgggtatccggccgaatcatcggggtcggccggcgcaggcgtatcggcggtgtattggcggcctccatcaatcgccattgatgagaccggcgtgaagtagacggtgtagtcgcttaagaccgcgccgccttccgacagacctgcgggaatgcgtgagtcgccgaatagggtgtcgtcgtactcgagattgacggaagtgatgcctcgctgggcgagcgcggccacggtggccttggccaaggtgttcagaccggcacgtccgttggtatggtttgcgtcggaatcgcctgcagacagcagcatgtcgccattgcctttgagggtcaacgtattggtgccgtcatcggattgggtcaggaacacttgggtatccaaggtggatgccatgttcagggtggatgaggcggcgagcgcggtcagcgttttcagtgtggatgcaggctcgcgtggagtgttcgactcatgttcggcagcgacggtgccttgagcgtcttcaatgatcaccgacgtatcgtttcccacgccttgcgcggacagcaattcgttgaccagtgcagaagcggccgtggaatcaatggccttgttcgcgttcagggcaccggcgatggtgccgcctgatttggcggtggccggattggcgaaaacaggtgcggtgacaggttttaacgtcaacaatccgggggccacgtcggtgatgtcggcggcgcagtaccccgcgaacagggcgatggtggtcagtgcggaaatgatgacggtcagtgttcggcgatgcgatcgttgggtccgccgttgcgcttcacgtcgccgacggcgtgataccgctgtagataccatcgtgctccttatgccaaggcaatcatttctgcaatgaggcgaacgagtcgagtgttgccacaatcgagagcattcgcgcatccatcagcttaccgcccagccatgtcccgagtgccagaatgccgatgccattggccagcgcgaccggaataatcgccagccacatgccgccttcggctcctgtcagcagcatgaccagcgccacgatgccagtgggcagcatgagcagcaggctgccaagcatgtagacgaacgggaagaagccttgggccatggcgcggccttgaggcgcggagaacggcttgtccattgaggcgaccgggtacatcagtacacaggaggtgacttcggccacgcccagtccgctcaaggcgatgcccatgcccgtggcgaggaagatcaggccggtagcgaggtcatcgggctgcgcccaacgtccggtcagtgcgccgaccagcacgatgccggcgagatagagcagcaccatgtagacgaccatgatgccgacgtagacgcgtacgcggccgattctgtcggtccggccacgcacgccggcgatgacttccatggtgaagccgcggccgtcatatgcgagcccgttgctttccacgacggacatgaaccagccgcaccagatcagcgactgccagacgaccgcgctgatgccgtgtgcctggaaggcgaagatgatcaggaacaggaccggcatggcgaaggtcatggcttggcgggggtctcgtttgagataggtgatcaggcgtgcggaaaccgcgccggatgccgaatcgggcatccatgcgaatgcgccgatgcctttggcggtctcggacggactgtttgcgccgatggtgaaccgttcatgtctcagacaccaggtgcagacggcgaagcagacaatccatgtgacggcaaggatggcgatgcgggcgagcagcaccgcccaggctccggtaagcgcgtcgaacggtagttggaaggccgcgccgaacggcgtccatgcgacgatggtggtcgccgcgccccaggtttcggtgttgaggctgaaggccacgccggagttgaccagaatgttcggcaactgacagatgataacgaacgtcagcacgatgaagatatagaacgcgcctttgccgcgtttgctggtcaccagcgtggtggatagggcgatgagcagtttggagatgctcatcatggtgatgacggccagcactgcggcgaggagggaactgatgattacggctggtcccatatgccgataggccagtgtccagagcatcagtgaggccacgccggtaagggcggggatgccggacaggccggaaagcagcaagccgaattgcaggttgcggtcggcgatgccgtagagcgcgaatttgcgtgggttcatggtggagccttcgccaagcatcatgagctggatgaagccgatgaagatggtcatggtcgcgccgaccagcacgacgactatgttgacgatgcctccggaaccaaggatgttcagcggaaagccatccgcgttcacggtgaagggcggcagtatgccgatgaaccatgcgagcacgccggtgccgatgatggtgccggccgcgagtacggcggaaaagacataggcgacggtctgccacgccgattttcgcagggtggcgagcgtgagcgtccagcgcaggcggaccagggtgatggcggtcttaatcattggcgggcctcatcggtgggtgtggcgggcgtaggcagaatcggctgaatcggctgggccgaagttggtgcttgggcttgggcctgcccgccatcgagccacgcgagatgggcggcttcgtggcggccaccgactagttgcaggaagcggtcttcgagttcttcgccagcagcgacctcgtccaccgtgccggccgcgcataccagaccgttgttgattacggccacatgcgtacacatcttttcgaccaatgccatcacgtgtgaggagatgatcaccgtgccgccagtcttcgcgtattcgatgagaatgtctttgaggttggcgctggacaccgggtccacggattcaaacggctcatccaagaccagaatgcgcgggctgtgaatcatcgcggaggccaggcagatcttcttggtcatgccggccgagtaatcggtgaccatcgtgttggcggccccggccaagtcgaaagcatcgagcaggtcctgggcgcgacgcgtggtctcctcgcggctcatgccgcgcagcatgccggagtagacgagcaattgcaaaccggtcagtcggtcgaagatctggtcgggctggggcatgacgccgatcatgcgcttggccgtattcacgtcgctccacacgtcatggcccagaatcatggcggtgccggcgtccggcaccaatagaccggtcaccatattgagcgtggtggttttgccggcgccgttagggcccaccagtccgtagaacgagccgattggaatgtcaagcgcgagcccgttgacggcgatcttccggtcgaagtgcttgaacaggccgcgaatggacaccgccgcattcgggttcggcggccatgcttgcggctgtggctgttgcgactgcgaagacgcgggagcggcggctggcatcatcggcggctgaaatccgacattcctttgagtattgtctaagctcatgcatctactctagcccaccagtcaaccctcagcgcagcacccccggattactgttggattgccccgctgagcagctccggactagcggactcggtcagcccttatgcgcgatgggcttccactgggctttggcgaagatggcctggaaggaaatcggcacgtagctgagcatgtaaatcgggaagctgagcacataggcgagcagctccttgttcgtggcaccgatctggtcgtgctcgacaatgatggtcaatgcagccaatgccatcaggcccaacaccgatgtgatgatgccgctggaccaaccggccagcgattgcagctggctcgaccaactcacgaagccacacgcggcgaacagcaagcccatcaccgcgcgaatcacgcccaacacggtaaacggacacagcatcaaggtgaagtcgatgcaggagaaatcacgttcgcgaaccgcgcgtttcagcaatgccgagccataataacggaatacctgcaggaatcccttgctccaacgcaaacgctgacgccaactttgcgagaaggtaaccggctgctcgtcgtagaggatcgcagtaccgcaatagccgatgcggtcgccatgcagaatcgaatccatagtgaattcaagatcttcagtgagcaggtggaacttccatcccttgttccgcttcatcacctcgcgggagaacatgaatcccgtaccgcccacatggcaagaggaaccgagaatcatacgcgagttagacaggaatcgcgattcacggatgaaccacagcgcagaaccagaagacacccagttatccgccagattcaccgaattacggtagctggtcagaatcttgaatccggagcagaacgccttgttcatttcctcgaagtaatgcttgtccagcttgttatcggcatcgaacacgaagtaggcctcataatcatcggccacaccgatgtcgagcatatgccccaacagatacgtcagcgcatatcccttgccaaccagttcaagattgtggcgttccaccacatggcagcccaaagaccgcaccacgtcggcggtgttgtcggtgcagttgtcggccaccagccagatgtcgatgaggtcggacgggtaggtctgatcgcgaatcgacccaataaggttgccgatcacgttttcttcgttgcgcgcggagatcagtacggcataccggttggtcatcggggcgtcggggaagcgcacgggcttggcgaacagggacatcacgatgcacagtccctgatatatcatgccggcaccaccgacgattaccagaagaatatcgagtacggaaagcagggtcatcagcgccaccccgccctaggattgctggaggcagattgatcagactgcttggtttgcttgcgttgcttgggctgctcagactgctgcgtatccgcggcaccacgctgcggaatcgccacggtggcggaatcgtccaaatcggattctttcgtctcgtgtagcggaatcgcatagatctgttcctgcagcaaacgcagttcctcattcatcggcacacggctggtggaccccttggccgcacgcggcatgtgctcgccgatcggctgcagcacatgctcgccgaacgcttcggacgcctcgacgatcttggacttcttctccggagtcggatcgttcatcagtggtgagtcaatcagctcatagcgcttggtgtacgcacggaagatggcctgcagcgatgcggtgaccggcagcgccaggaacgcgccaaacgcgccgaacagcgagccgaacgccagcaccgcgaggaaggcgacggccgcgttgatatccatcgtgcgctgcgaaatcctcggtgagagaatcaggttctcgatctgctggtagacgatgatgaacaccagcaccgccacggcgtacgtccatccgcggttgccccaagcgaacagcaccggcagcgcgccgccgatataggtgccgaccgtggggatgaactgggacaccacgccgcagaacagggccaacggcagccagtagggcacatgcagaatctctaagaagatggcagtgcaggtggcgttgatcaacgccagaatcgaacgggagaacaggaaggacgaaatctggccttgggccacggtccacaccagcaggaatcggcgctgcgtgttgggggccagccactggcagaaggagcggcgcagtttggggccggcggcggagatgtaatacgtggtcatgaccacggtcatgaggttcagcaggaaggagaacaggccgcccaccgtactcatggcggtaccggcaaaatcggtgacccacgaggtctggatattgttgaagatttccatgccgagattgctgatttccggcatcttgaacgtggcatactggtccacgaactcacgaatctgctcatacatggccggcaaaccgcggaccatggcaatcatctgctgtacgaacatgttgccaaatagcgtgagcagcacacccacgaccacggccacgcccaccaagctgacggcggaagccacgccacgcttccagccatgagccaccagcgccaccaccagcggttcgacggccagcgccaggaacagcgagatgatgatgtcgagcaccagataggagatgtcgccccacgagcgccagcagaacatgaatacgatgacggcgagggccacatacagcagcgcgcggccgaaccattccggtggcctgcgggaatctcccttggcggggaacaaagtaccaaagtcgatacgattctcgtcgtccgggtctgccccggcctctgcggcaccggttctcgacgtgtcggtgctgtttacgtttcgcacgcgttcgctcatggctccccattgtagcgaggggtttgaagctcggatacgccggcggcgtacacccgcttttctattgttgatgttatgctcaacgtttcgatcatcatcccagcgtggaacgaagccgaacgcatccgcgactgcctgctgaacgccacccgtcagaccatcatgccgcatgaggtgctggtggtggacaatcgttctacggacaacacctgtgcgattgtcgaacagttcattgccgaacatcccgaggccccggtcaaactgttgcaccagaacgatgaacaggggctgattcccacccgcaactttggcctgaacgccgcgaccggcgatgtgctgggccgttttgacgccgactgtatgatccggcctgactgggtggaggtggtctccggcatcttcaccgaagacccggccgcgatgggtgccactggtccggtgatgtattacgacatgccctcacgccattttgggttgaagggcgacaattccttgcgcaagcgaatctaccgcgccgatggcggccagccgctgctgttcggttccaatatggccttgcgcgcttcggcctggtatcagatcgcgaatgaggtctgccgggataaggccgatgtgatgcatgaggatatcgatatttccctgcatctgatgggcaaggatctgaaaaccgtgtactcgccgcgcatgatcgccgcgatgagcgcgcgacggatggatacgtcgttgagttcgttcctgaactacatgcgacgttttaagaatacgtttgatgcgcatccgcaacatacgcgcacgcataagccggaggtgttgttcaccgccatgtatccggcgatgcatatgttctacccggtgtggcagaaagtgctgaattccgcggatatcaatccggctgaagccgcgtggatcaacgagcagatggaactggcggaggcgcaaggcaagcagctgtacgacgagacccccaccgacgaagtctacgacgaaaagcacgaaaagtagctcgatatacaagccctctctgcttatgcaagctccctctgataagggagctgtcgaacgaagtgagactgaggaagagactgcgacgcagtcgctaaaacattgaatcggacgcaggccgatacctattattcagcggctacgccgcaacttctctccctcagtcagctacgctgacagctccctcatcagagggagctaatgtttactgtcattgactgatcacatcagcgacttgtaaatcgcgaggatgtcctcttcggttgcctgacgcgggttgccgggggtgcacacgtcgttgaaggcatcgtgagccagcggctcaaggtcggcctcggtggcgcccacttcggaaatcgtggtcgggttcttcagatccacggtcagcttgtggacggcctgcacggcctcttcgcgcaccttctccaggtcgccggtgtaggcgtcctcaacaccgaacgcatcggcgatgtcgcggtacttctcaccggtgaagtccttgttgtattccatgaccggggccagcagaataccgttggccacaccgtgggccacgcccagacggccgcccagcgggtgagccatgccgtgcaccagaccgaggcccacgttggagtaggccataccggtgatgtaggacgcgtaggccatctgctcgccggccggaatgtcgccgtcggcggacttggccaggttcttggcaatcatgcggatggtctgcatggacaggcagtcggacaggctccaggcacccggggtaatgtaaccctcgatggcgtgggtcagggcgtcaagtccggtggcgaccttcaggccgcgcggcatcgagtcggtcagatccgggtccacgaaagcgacgatcgggatgtcgtgcgggtcgacagccacgaacttgcgcttgttggccgtgtcggtgaccacgtagttgatggtcgtctccgaggcggtgccggcggtggtcggcacgccgaagatcgggacggacgggttcttggtatccgcgacgccttccagagaaagcacgtcggcgaactccgggttggcggtgatgatgccgatgcccttgcaggtgtcttgcggggagccaccgcccaggccgatcaggaagtccgcaccggactcggcgaacttggcgacgccgttcttgatgcactcgaccggcgggttcggcttgacgttggagaacacctcgtacggcaggccggcctcatccagaaccttggtgaccttctcggcggtgccggtctccagcagcaccgggtcggtgacgataaatgccttggtgaagccgtgctgcttggcgacggccggaatctccttgatcgcgccacgtccgaagtatgcagtctggttgaaaatcatgcggtacaccataggggctctccttttgagctagtgtcttaactggtggtccactctgtctttgagtggtccaacggttccccagtctactccgcgcatgagcattcacctgaaaaccccgggttctaaatagaagtgcaacaccttgtctagggttggaagtgttcgaagggaaccggcgacccggccccgaccatcgggacctaccaaacatggtaatgggcttcagattcggagcttttccgctcgggagccgcgggcgcaccaaacattccggagagtgcgcgagcagcgagagcttggcgcgactcggcggaatcgtcacttccggctggtaccggcagcgaatccgatttccacgtatcgcccgaacgtcgcgccatcatcttccccgtctcccgcaaagagcagaacaatgacctacgcgacttgctgatttcgcagcaggtacgtcgtatcgacgaactggagcgtcaggtcgacatgctcgaggccctgctgcacggcaggcggcgtaaggaacaggctgccaatacgttgcctgaggaacagacggatacagcggcggacaagtcgccggatacagacgggcaacagcagtagcctgtctgtatccaatcagtgcgcgaaaccacagggaacatcaggtacttgcccaacacgcacgctaagataggcatcgcaataatcggcatggcaatacatggcaataagcaggtaatcggcgaggcggtgcatggagcaggaatccaacgagcaagaacctaacgaggcgacggaaatcgtaggcggcaaagtagagaccgtcgaggtttccaggcaccccgaggcttccatacccgagaccgatttgtctttggctgatatcgagcgccgtcgctcccatccgttgcgttgggcgttgattattcttgccgtactgtgcgccatcatcgcgccatactggttcggtcgctcgctggcggtgaataatactgactccattgtggccgtgctcgggggagtgtctccgcaaggtatcgcactggtcggttgggtggccgtggtgatcacgtacgtcggattggcgatggcggtggtcgtctcgccgtcctggccatggctgatcgtgttcgtgctcgggctggcctgtgagcagttcatcgcgggactcagcatgctcaatctcaacttctggtattccacgtacgtggtctacggcaagcaggccggtctggcaaatgccgcgaatctgggcattatgggggcggcgatcggcatcgccgtatacgccctggtgtttgttggtctgctggtgattatccggaagacctcgccgctgaacgtactgaccaaaagctgggcgagtttcattctgtacttcgtgattgaaaccatcgccctgctcgtggtgttgttcggcggattgctcaccactgtgtgagcgcacgtgagtcgccgtacgtcgctcaatactcaccactcactgctcaccgccgcgcaaaccgtgtgcccgatgtctatttagaggtgcaacaccccctgttggtcctgcaattctagcagttcgtcggcgaatgcctcggcgggcgtccggtagtccagcacgcgcatgggacggttgtcggcctcgtcgacaatctcccgcagttccccggccatgcccatccggatctcgctgcgtttgggcagataccggcggatcatgccgttccggttctcgttgcttccccgccgccggctggagtacgggtcggcgaagtacgtgtccatgcccagcccgtcgcgcaggcgcgtgtggcgggcgaacccggcgccgttgtcgtgcgtgacgctgacgcgcgcgccggcggaaccggcgacccggccccgaccatcgggacctaccaaacatggtaatgggcttatctcttcgcctgagtgatctggtaggcggcgaagaggatggcgagccaaatcacgccggcgatgacggcgacgcggtagctggcggagaagcacatcagcaccacgaccagtgccaggaacgccaataccacccacggggttactttggcgaacggcagcttgaagtgaatcgcgtcgagcgcttccttgccagacttgccggccagctcggaatcctcgggagcgccgcccgcggcgaccaccttacggaacttcatttcggtgaacataatcatcgtccagttgatgatgccggcgatggtggcaatcgacatcagatagttgaacgcgaactcaggccacacgaacaccacgaccacggcgatggcggtgatcacggcggacgtcagcacgccggccaccggcacgcccttagcattgagcttgcccagatacgtgggcgcattgccttgcttggccagcgaatacagcatgcgggagttggcgtacaggccggagttgtagacgctcatcacagcggtcaggcacacgaagttgaggatgccggcggccgcgtggatgcccacggaatcgaagatttgcacgaacgggctgggaacatcgtctccgccgatggtgttccacgggattacggccatgattacgccgagcgcgccaatgtagaacacgagaattcgccagataatgtcattggtggcgcggggaatcgtacgacgagggtcctcggtttcgccggcggtgatgccgatgagctcggtgccgccgaagctgaacatcaccacgacaagcgccatcaacaggccggtccaggtgccgtccttagtctgctccatgaggccgttcgggaagaagcccccttccagggtgaaccagttggcaaagctcgctttgatgccggatgcggtgggcagagcgaagatgatgacggccaggccgccgataatcatggcgatcacggccacaatcttgataatggcgaaccagaactcgaactcaccgaacttggagacgcccagcaggttggcggcgcagatgaccactaggaacacggccgccgacacccatgtcggaatcgctgggaaccagtagtttacgaatttgcccaccacggacagctccaccatcgagacgaggatgtaattgaaccagtagttccagccggaaataaagccggcgcgcttggaccagtagcgggtggcatagtagctgaacgcgcccgccttcggatcctcaacggacatttcagacagtgcacgcacaatcgcgaaaatcgcgaggccgccaaccaagtaggcgagcagaatcgagggtccggccagcgcgatggattcactggaaccatagaacaggccggttccgatggcgccgcccagcgcaatcagctggatgtggcggtttttcaatgacttgcgcagcgtggccggcaccggcacgtcgtcggtttcgcgcggcttcttaggcgcatcagtagtactcattgtgctcttctctcacatttcttgggtttggcgcacgcggggcttgccgtgatgcgcaacgttcgttattctatgccgccgtatcgtctcagaaatggtcaatcgtctatttgtgcgctattgcaagcgcgggcgtgggcgcggccggtgagcaggcgaagctatagcgagcgatgcttatgaaaccgcacgcttcactgagttcactgaattcaccgtgttcactgcgtggcaggcatacacatggtgaagatggtgtgggacaccgattcgggagaggccgcgagatcggtggcgagccaatattgcaaaagcccaatgctgccggacacggcgaatcgcatacgcatctgcgcctcggctgggtaacccgccgaagattgcaactgttcgcctacgccgcgctggctgtaaatcaatcccagcagctgctgctggaagccgatatccgctttcgggctcatcaatacctgcagatgcttgcgattgtcggcaatgtactggcagatgcgctcaataacatgctcgatgccggcagaatctggctgggcgagtagctgttcgagtgcggtggtgacccaggccatggtttcgtcttcaatgtcgtgcagcagttcctcgatgctcgcataatgcgcgtaaaacgtggaacgattcacatcggcccgctcgcacaacgctttaacggtgatggagccgagcggctgattgcgcagcaactcgataagcgcgtcctgcatggcacgtctcgtgtagcgggtgcggcggctttccgtcaattctttggccatggccttctccccaaattccgacaacccacaatccaactgttggttgcagaaccgacacagtgttgttttacttgagtatagcaggaagttttggcggggcctatggggctaggtggctgccacgagcgcgttggaggtgtgcgatggcgtatatcgaattcgaccatgtggtcaaggaatatccttctggtagcagtgtgattcgcgcgctcgacgaggccagctttaccgccgaacaaggcgaattaagcgtgattctgggacagtccggtgccggcaaaaccacggcattgaacattctgggcggcatggataccgccacaaccggccgcgtagtggtcggcgggcgcgatattacgggcctgcggaaaaagggactggtgacctaccggcgcaacgacatcggcttcgttttccagttctacaatcttgtgccgaaccttaccgcgctggaaaacgtggagcttgcctcacagatttgccccgaccatttcgacccggtggaaaccttgtacaaggtcgggttgggggagcgcatggggaacttcccagcgcaactgtccggcggcgaacaacagcgtgtatccatcgcccgcgcgattgccaaaaagccgaagctgctgttgtgtgatgagccgaccggtgcgctcgattacgagaccggtaaggaagtactgcagctgctgcaggatatttgccaaacgcaaggcatgaccgtgatgatcatcacgcataattccgcgcttgcaccgatggctcataaagtgattcgcttccgctccggcaaggtggccagcgaggagatcaacgcaacgccgcagcccatcgccgatatcgaatggtaggtgattggcgatgctcactgcaagacactctgtgaaacgccccgtgaaacaagcgaggcgatttgtgaaacattctgtgaaacggcggaacctcgacgatagcggcggtcgaggagcgggcgtttctgcggtatttgccaaagatacgttgcgttgctggctgcgcagctggaagaggttcgtctcgatcgccgtcattacgctgcttggcgtggccgtgctgaccggcatctacgccggatgccgcgatgcttttctggcggccggtcgtttttacgatcagcagggactgcatgacctgcaggtgctatccacatacggcctgaccgatgatgatgcggcggcactgcgccgagtcgacggtgtgcaaaccgtgcagcccgaacgttctcagacggtgaccacgttggtggacggcaccaagaaaaccgtgaccatgcaggaaatcggtaccgaagggcttgatcagccgtacctgcaacaaggcaaactgccgaacaaggccggcgaagtggcggtgactcagcagttcctgaacgatagcggactcaagattggcggcaccattactgtgacgccacaagacacctcttcatccgtcatatcggtagcggccacggagactgacgattccaataatgattccaatgacgattccaataatgccgatacggtaggtgtcgccgccaatacggacgccgacgccgagcaatccccgcagttccccacgaaactcaccatcaccggcgtcgtactcgacccgcgcgatctcaacaatccagacggctattcggacatgacctccttccggtccacctcatccgaggactatacgttctttgcacccagcgacggcgtgaccggcaatatatacactgcgatatcggttgccgtcactggtgcgtccgattttgacacgttttccgatgcctacgatgaagccgtcaaaaccgtggccgaccgtatcgaacatcagatacagaccacacgccagaaagcccgtcgtcaacagatcgtctccagcgcgcagcgcaaactggacgatgcccaagacgaggccaacgagcagctggacgaagcccagaagcagatcgacgacaactgggccgagctggaagccaacgaaacgacattgcaagatagccgtaccgaattggagaacaacaggacaaccattaccgatggcgaacggcagctcgccgatggacgtgcgcagattgcatcggcccgtcaacagatcgcgcaaggtcgccagcagatagccgaagcgcgcacccagctcgaatcgggcaaagcgcagctcacctcggctcgcaaacagctcgatgcggcgcaaacggaactgactgccaatcgcacgaaaatcgaacagggcattacccaaatcgaccaaggcgtggcacaaattgatcagatgctgtccatgattcaacaggccgacaatctactggcgcaacttgacccgaatatcgacttcaactcacccacatggcaggccatcaagcaactgctcgcgcgccttggcattaccctgcctgaagtgccgtcaatcagtgagctgcggcaacagctggccgccaagcaaacggaactgcaaacgcagcgagacagtctgacccagcagaaagccgatttgcagcgcacattaaacgaaaccattgcccccgcacaatccaccttggaccagcagaacgcgcaactgaccgccaaggaacaggaagcggctgcaggagaggcacagctcaataccaaatccgcggaactcgaagcgaatgccgcaaccctcgaaacccagtcggcgcaacttgaagcgcaggccgcccaactggccagcggcaagcagcagctcgaagaaggcgagcggcagctggaagaaggcgaacaacagctcgcggacggcaaggcgaaactggatgatgcgcagtctgaactcgatgcgaagcgaagcgaagcggaaagcgaattcgccaagcagcaacggcgcatcgacgatgtggccaacgcacgttggtatgtgcagacacgcgcttcgatcgacggattcagctcgctcaaatcagacgtcagttccatcgaatccatcggccgcgcattcccgattgtgttcctgctggtcgccgtgctcatgagcctgaccaccatgacccgcatggtcgaggaagaccgcggacttatcggcacctaccttggactcggctatggcggactcgccgtgtccagccggtatctgctgttcgcgttgctcgcctgcttggtcggcggcggcatcggtctgctggtcggattcctcggcatcccggcattcctgctggtggtgattgagggactgtatatattgcccggtgtgcgactcgaatacgactggttgtacggttcggccggcatcgtgctgttcgtggtcggcgtgggcgtggccaccgcgctcgcctgtcgcgaggagatacggcacacgcccgccgcgttgatgcggccgaaggcaccgaaagcgggcgctcgcatattgctggagcggattcgcccggtatggagccggctgaacttcctcggcaaagtcactgcgcgcaatatcttccgattcaagtcgcgtttgattatgaccgtgggcggcgtggctggttgcacagcgctgattatctgcggatttgcgattaacgacaccgtcgacacgactggcgtcaagcaatatgagcagatctaccagtatgacttgatggtggtggccaatgacgatgacgccgccgcgatgcgcaagcaggtggcacaagatggccaaaccaccgaaacgctgaatctgcgcgtggatagtggcgagatgagcaatgcggcgcaggaaagcgaaaccgtgcagctgatgacggtgcccaacaattcgttgaacaaactgaacgacatggtcacgctggaagaggccggtgacgatgggtggttcgagctgcccaatatcttcggcaaagcgggtggcggcactgtagcgctggacgatagtggtgtgattgtggcgaagtccgcagccaattcgttggatattcatgcgggcgacaccgtcacgttgagcaatggcggcagcgggcgggccaaggtgaaggttgcggcggtgacgcgcaacctcatcggctctgatgtgtacatcagtgagcgactgtacgaccagaagtttgcggccgacggtgtgacgtcttcggcttcgggagatggcactgcctcgaccttgacgtggaacgcgatgctcgccaagctgaaaggttccgagaccgaacaggccgaatatgcggatcggttgggcgaggaatcgtcggtgctcaaggccgtgagctgtgcgcatctggccgccatgtttaagttcgatttgatgggtgccgtggtggcgctgattgtggggctcgccggcggcctggcgctggtggtgctgtttacgttggccaatacgaacgtgtccgaacgcatccgcgagatggccacactgaaggtgctgggcttctatgaccgcgaggtgcacaactacgtgaaccgcgagatgatgatattgaccggtatgggtgtggtggttggtctgccgcttggcaggtggataggcggattactgactgctgcgttgaatatgccgtcgctgtatttcgaagtggaagtgcactggtacagctatgcgattgccgtggtggcgacgctggcgttcgcgctgctggtgcagctgttcaccaacccagtgctcgatcgcgtagacccggtcagctcgctcaagtccgtggaatagaggtagaagttcaatttggtgttgatgaattgaactttttggcggaatatttacagtatcatcgcatgtattcttgagctgagcggttttcgtgacatatttcggtgatacagtttgaacttgttttgaacgagtatcgcgtctggtgcgtaacaatcgggcggcagggaagagaaatgaaatcagtatggccgatacgaatgtgaatggtggtacacagcaggctacgggcaaactcaagtctgtcgaaagcctggaccagaccaacgagatggagcgtggcctgagcaatcgccacgtacagttcatcgccattggcggcaccatcggcaccggcctgttcctgggctcgggcaagtcaatctcgctaaccggcccctcgatcatcttcgtgtacattctggtcggtgtcatcatgttcttcctgatgcgcgccatcggcgaaatgatgtaccgtgaccccagccagcacaccttcatcaatttcatcacccgttaccttggcaacgggtgggggcatttcgccggctggacgtattgggccgcgctcgtgctgctgggcatgaccgagatcacggccgtctccacgtacttcatcaccttcttcgacacgttcggcatcgacctgacccattggaaatggctgatcgagctgtgtttcctggtgtcgctggtctccatcaacctgattgccgtcaaggtgttcggcgaggtggaattctggttctcgatgatcaagatcacgctgatttgcgcgatgatcgccaccgccgtggtcatgatcgtgatcggctaccattacccagccgtgcagattcacggcgtggaccacgtgagcccggccggccacgccggattcgacaacctgttcgccaacttctcgttcgcgccgaacggttggatggccttcctcatgagcttccagatggtgttcttcgcctacgagatgattgaattcgtgggcgtcaccgtctccgagaccaagaatccgcgcaaggtgctgcccaaggccatcaacgagattatcgtgcgcgtgctcatcttctatgtgggcgcactggtggccatcatgtgcatcgtgccgtggacctcgttcaagccgaacgaggacggctcctttgcctccccgttcattatggtgttccagtacgccgggctgaattgggcgtccgcgctggtgttcttcgtggtgatcaccgccgcatcttccgcgctgaactcgctgctgtactcggctggccgccacctgtaccagctgtccgaggtgtcgccgaacccgatgctgaacaagctcggcaaggtgtccgatcgcaaggtgccggcccgcgccatcctggtgtccgcggcgctgatactgctgtcgccgatcgtcaacgccatccccggtgtgtccggagcgttcgtgctgttctcgtccgccagctccgcggtgttcctgttcatctacatcctgacgctgctggcgcatcgcaggtaccgccgttccgctgatttcattccggacgggttcgtcatgcccgcgtggaaggtgctcaatacggtggcaatcgtgttcttcgtgttcatctacctgacgttgttccttgcggacgatacgcgcaattccgcgattgccggcctggtgtggcttgtgggcttcggtggattctctatgctgcgcgaacgctaccgtagccgcgatttgaaggccgcactggaacacaaggagtgattggacgggctgattggctggcggctattggttgggtggctgttggctgttggcggctgactggctagcggccgatagccaatgactgggctgatcgtcagccaatcggctgcctataggtctcattgatacattcggtcatccgattagtgcatttgcgcggacaattagtgcattcgatcatcggattagtacatcagtgtgcaattattagtacaattagccgcctaattagtacattaggacataaaaacaatgtcctaatgtactaattagatgctaaaatacgataagtgccatgtcctaatgtatgaattatcgctatgaagggcggaatgcgatgacgcaggatgaacttatgcaagtgctgcaggccggtgaatcatctatggtcgagttcaagcgctgcagcgaattgcctcatacggatacttttgagactgtatgctcattcgccaatcgttctggtggcagcatttatcttggcgttgacgatgacggtcaagtgctcggcgtcgattctaagcgcgttagtgagatagagcgcaacgttgtcaacgtagtgtctaatcgtaagatgttcgaaccggctccaatggtggaaacggaacatatcgagtacgacgaacggattattgttcgtatttgggtagctccgagttcttcggttgtgcggttcaagggcgcagtgtttgatcgcattgctgatgtggatacacacatcgaaagcgatatccagattagtcaaatgtatattcgcaagcagaactactattccgaacggcgaattttccgttacgtgactccgtttgatttgcgtcctgagctgattgcgcgaatgcggcagctggcggtcgctcagcgagctgggcacccttggggaactatgtctgacgaagaactgttccgcagcgccaagctatacgatcgtgattacacgaccggcgaagagggctttaatcttgctgcagtgctgctcttgggcaaggatgaagtcatttcctcggtttgcccagcgtatattactgatgccgtggttcggcgagacaatattgaccgatacgatgaccgacttatggtgcggaccaacttgttcgattcgtacgagcaactccgtgaatttactgagcggaatctgcctgaccactttgtgttaaagggcgataagcgagtgagcccgcgtacgatgatcgcccgtgaattggtggcaaacagcctcatgcatcgggagtattccagtccggtggtggcgcgtgtcaccattgataatgaatccatccggacggttaatgcttcgcgctcattctttgaaggtcgaatgaagctgggcgagttcacgccaatgccaaagaatccgattatcgctaatgtgtttgtgcagaccggcatagccgagcagctgggtagcggactgcggaatctgataagagcgtcccggcaatatactgagcgagagcctgagttccgcgatggtgacatattcgaggcgacgattcctattgttcctgcgctgaagaccgtggatggttctggttttgctagcgtgagatctgtagttgagaaagatgccgaagagggtgcgaggctcattggcggggaacgtgtggatggtaagaaagcagatgcaaccgcatcgggtgaaattgattcgcgggcagcgatgctgtcggcgatgaatcgacgcttgacagaggttgactatgtgactgtacctgaactcgccaagataacagagctcgataacagaacagtccgcaaattcctaaacggtttagttgcgcaaggaaagctgattgctgaaggcaacacgcgtggtcggcgttatcggaagggatagcgggcgcgatatctcgatgcagtgggattcacttaagggctacggcaaatatgattcgtagcgattgggccagcgcaattcgaatggctcatgactttgtgcgtcgtttgtggtctctgaagttgtttgctgggtgacggttttgtgataaaatcgctcatatcaaaatgtttgcgtaaacattttggctgcgccgaaagaaggagtcgacgtaggtcatgtatcaggcaaagaggccggcgcagtgaagcaaaggccgatttttccggtataaggcggatagcaggaacactaaggagaccaatgaaggtactgagcaaatcgcttgctgcaatggttgcggcggcaacactagtgggaggaggggcgtttgcggttgccggcactgcgtatgcggctgataacgatgccattaccgtgaccccgaacccgtggtatgccaacagtttcgatggctggggcacctcgctggcctggttcgccaacgccaccggcagcctcggcgaggaatcggccatcaccaccaatctcggcgatgacgcttccaaggctaaggctgtggaatacggcaaacagctgcgcgaacagttctaccagtccatcttcggtgatgaaggactggacctgaacatggcccgctacaacgtgggcggcggcaatgcctccgatgttgcctacggctacccattcatgcgccaaggcgctgccgtgcctggcacgtggaaagatgacgccaccggctccggcacgtatggcaatggcgtaaccaccaagcaggccgacaaagacaagctggctgcggcattcgacccgactgacgacaaccagtatgacttctccaagtccgccgcccaagactggtggattgagcgcggtgccaccggcgataaccctgacatcaccgacgtagaggccttcgccaactccgctccgtggttcctgaccaacagcggttacgccactggtggacgcaactccggtagcaataatcttgcaaaccctgagaaattcgctcagtacatggccaagaacgtcgagcacctcgaaagccttggcgcaaacgttgacacggtcgagccgttcaacgagtccgagaccagttactggggcactccgggcgatatggcttcgaagtacaccgatgagagcgatgacaacaccaagctcattaacaactactgggataagtactactccgacaaagataagtccgtcaccccatactccaacgcgctgaagaagccgcaggagggtatgcatgtcagcaacgcccagcagcagcagacgattaccgcactcgctgaggcgctcaaggacaatgatgacaccatcatcgcagccaccgatgccacgaactccgccgacttcgtcaagtcgtacaaccagtacccgcaggcgatcaaggaccttatcggccagtacaacgttcacgcctactccgacagcaaccagatgcagtcgcgcgatatcgctcaggcagacggcaagaagctgtcgatgagcgaggtggacggctcctggcagtctggctcctacaacccgtacggtttcgacaacgcgctgggcatgatgagcaagatcagctccaacgtcacccgcctgcagtccaaggacttcaccttctggcaggtggtcgaggacctctacaacatgcagatggggtcgaatgtgaatccggccggtgagaacaccaactggggcaccgtgctcatcgacttcgactgcaccgtggctggcatggacggcaagctctactccgagcgccgcgtgaacaacaacggcggtaccaccgatggacttgaaccgtgcacggttattgcaaacgccaagtacaacggcgtcaaggccatcacccacttcatccacgcgggcgacaaggtcatcgccaacaacgatgaagacaacaacatgactgccacctccgacgatggcaagacgcagaccgtcatccaccgcaactccggcacctctgaccagaccttcgtcatcgacctgtcgaagtacggcgagattgccgacaacgcttacggtgagctctacctgaccaccgaaacctctgccgaagacaagaacgcgggtgtcgattccgccactccggaagtcttcgccaagaccagcaacgtcaagcaagctgaaggctctgtgatgattgacaaggctgccaagaccgctacggtcactgtgcccgcccgttctatcgcctccatccagctcactggcgtgaccggctacgctaaggatgctgccgtcgagaccggcgacacttaccagctcgttggtaagcagtccggcaaggccgtggctgataccacttctggtgattccgcgctgtccctggccaacgtcgcttccgatgccgagaacgccaagaagcagacttggacctttacccagatcgagcagcccgccgactccgagcgccctgatctcaaggcttatgtgattactaacgccgaaggcaaggtgctggtgtccaaggatggcacgaacgcgctttccaacgaaacggttgaggccgctaagtccgacccggctgccaagtggattctcaacacttccgatggttcgacctaccagctgctcaatgccgcgactaagacgaacctcgatgtggataactctggtaccacagtcggcacgaaggttggcttgtggcagtcaccgagcggcacttcgccgtccgccaaccagacatggactctacgcaatgtaacgccgaccagccagaagaccgtgaacgtgcagaccgccgttaacgagaaggccgcgctgccgaccgaagtcacgctctactacacctggggcgaaggcaaggccacggttgccaactgggatacttccaaggtcgatgcggccaaggaaggcacctacgaagccaccgctaccgccaccgatgtgtacggcaacgagttcaatgtcgccgctacggtctacgttggcgcgctcaccgtttccgatccggtatcggctacagtgctggccggcaccagtgcgagcgaggcgaaggccgcgcttgaggctgcgccggtgtatctgcacgtcaaggcatcgcctgcattcgagggcgatgcggctaaggttacgtggaacttcgatgggcttgataccaagctcgccgatgccaaggctggcgacaacattgccgtgaccggtacttaccagctggacgacgcgaccacgattgcgctgaagggcacgatctatgtcaccgccgccacgcctgagaatgtggccgacactgcttccagcctgaccgtgaccaaccagcagacggaatacagcaagggcgatcagtggaagaagctcaccgatgacgatacgtcggccgaggcttgggtgacgtggaacgcaaagaatgattactctgccagcccgaccgccacggtgaacttcggcgaagagcgagaagtcaccggcctgaccatcacctatggtgacaaggctccggcatccgccaaggctgagtacaccactgatggcaccacatggacgcagttcggcagcgaggtcaagcccaaagccgggcagactgttacgttcactcctgaagatggttcactcaaggccacgcaggtgcgtatcgtcaacacgcagaacggcgacttcatgaacgctaccgagatcgaagcctttgtggttccggttgtcggaggcgtgaagaacatcgccgcggcctctggcacgaacttctcggtgaacttccaggagggtgcctccgcttccaaggccatcgatggtgacactacgtcaaagggttggtccacttgggcttccaccgcctcgacggtggacccggtcgccacgttcaccttcgacgaagctcagaccatcaccgaagtgaagaccttcttctactacgatggtcgtgcgtcttggccgaagagccagacgctggaataccaggatgaggctggcgaatggcatgaagtcggtaccaaggatggctggaagacacaggccggcgatgccggctctggctccgacggcatcaccgccgccgacaccccgaccgttgacttcgtgctcgacaccccggtaaaggccaaggccatccgcctgaccaacacgttgcaggacaccaaggtgtacatcaacgtggccgaaattcaggtgttcgcacaagacagcacggtactcaccccgcagccggcatccgatgccacgctgggcgacctgcgtcttgacggcgagaccatcaagggcttcgctgctgataagaccgactacacagttgatcttccgttcggtgctgaggcaaacccggtgctgcaggccttcgccgccgacaatgccgccaccgtcaaggtgactggcgacgcggttgagaatggcaagcttggcggcaaggccaccattacggtgacctcagccgacgagtctgagacgaagacctacacggtgaccttcaaagccttcactttggcttcgctcaaggtgaccggacccacgaagatcgagtacgccatcggcgacaagctcgataccgccggtctgaaggttactgccgtctatcagagtggcgacaagaccaaggaagtgccggtcgctcttgacgacccgcagcttgcgattggctcgttcgactccaccaccgcaggcaagaaggcgattaccgtctcctaccgtggtgtgaccgcgaccttcaacgtcacggtcaaggccaacgcagtcgcccctggccctgaagaacagaagcccggcagcaccaacaagcccggtgccaccggcaacggcaacaagaacacggtggccaacaccggttccaatgttgccgccatcgctggcgctgtcgctctgctggccgctgccgcgggtgcattgttcatgctgcgcaagcgtgcatagcaccctcgcacagtaatgggggaaggaacaagccggcaatattgactattgccggccggttcctccgctctttgagcataattggtccgacaagttgaatactgagttttcagtatcggtatattgatttgtcggcccttttctgacttcgcggatagcgacataactgtttgttcaaaaaaccgttatcatcaatcaaggaaccaaatcaatgaagataaacaataagggcaagggcgctcttatcgcggcaattaccgccgcggcaacgctattgtcatgcgggctggccgctgcaagtgccagtgcggcaggtgtggattacctgcctaccatcggccaagtgccgacatacaccaagttccagcccacagccgatccgggcaagaacgctagcgattacttccagccatattggtatgccaagaacgccaatgataatggcggcacacacatccaagcgcacggtggccaagtggtcaaggttggcgacgcctactactggtatggcgaagaccgttctaacggttacgacaacagccccggtgttcatgcttatatgtcgacagatctatacaactggaccgatcttggtgtggcgctgcgtgcggtgaccagcaaatctcagttgacggataagagcaatgccgattacgcctacttcgacaaggcctacaacctgaccaagtccgacggcagtgtggacgctgccaaggccgacgcaatcttcccgtacctcaacaccaaccccgatcaggatggtgatggcgcggttgattccgtacagggcattttcgagcgtccgaagatcatctacaacaagaagaacaagcaatacgtgctgtggtggcattccgatggaagcaccacgccgggcggttccaactatgcacgtgcacttgcgggcgtggctgtttccgacaatccggcgggcccgttcactatggtgggtgcctatcgtttgcctaaccagaacaattggaaagaagccgcaggtaaccccagctggggtgagaacggtgacagccgcgatatgactgtgttcgtggatccgaaggacgacagtgcctatgtactgtattcttccgaagccaatgccacgctgtatatcgccaagcttaacgatgattacaccaatgtagtcaagaccacgaatgtggaccagtccgagggacaaaagcagtactctgctgacgggcagtacccatacattcttgcagacggtactacggatgccccggtgcgtggcgaagatttccaaatcgtcaaacaaaatggttcgctggaagctcctgccgtattccaatatgacgggcgttacaacatcatcgcatctggtgcaaccggctgggacccgaacaagcagacctactacaccgccgactccatgctgggaagctggacccgtggcgtggaaaaggacgatgccaacgagaacacgtggtacaacaacatgccggaaggcgcggatggtctgttgtctgtgggcgatacccgcggcaccacattcggttcgcagtcggctagtgtgctcgcagtagaccaggagaaaggtcacttcatctaccttggtgaccgttgggattccggtaaagccgattccacctatgtttggctgccgctgaccatcggtgagaacggcaccatcgaaatgcataatcctgctcaagaaggcgagcccgacggctgggatctgaactattgggacaaccatggtagcgccaagggcaagctggtcaactggactgtggaaaccggcgatgatctcccgaagaccgtgaacacgggcggaaccgttactctgccggacaccgtcaacgtcaaggaaggcgacgataccattgctaccaaggtgacatggaatgtggaaggcggtacggcagtcagcaagtcgaccaaggctgccggcagcacctacgcattcaatgtgccgggaacctacaccattacaggcactcttgccgagagcagcaacttcaacccgggccgcacattccgcagaaccatcgacgtttcctgctccaacccgatttccggaagttggaaggaagctcattggaagggcggcagcgcgtgccaggtttctgcgtccggcggtgcttatgacttcacgattacggacaacgccaatcgtggcgtctggacggatcgcaacgagggcagtgcggtgtaccagcctgatgctctggacgtgaacgaaacgctggaaaccacggtcaagccgctcgacttgggcggtaatggcgatccgcgcgccggtctggtggtccgtaacggtcttactggcgctaacggcggcaagggatatgccacgttacttgccagcccaagcggcgtttacatgcagtacgattccaatgccgatggctacatcgataaggaaacatcgcatgttggtaccggcttcggcgaccaagtgcagctcaagctggagcgcacctcaaccgatactctgaaaggctactggcgtgcttccgcgaacgatgaatggcgggatgtcgctacggtaacgctgaccggtgcggacgtaaccgggctcgatgccggtgctttcgccacgtcgaacagcaatgccggcgcattcaccgtggccttcaacggcactgcgttcggttcgcagactgctgctgtggagtccatcgcggccaagggccctgaagccactatcgccaagaggcagacgctcgcgcataaggacgtgacggttaccgctacgctcaccaatggcaagacgcgtgtactggagccagatgaatacacgttggaaggcttcgacaccaccaaattgggcgagcaaaccgtgacggtacgccttgtcactgattcttcagtaactgccacgctcaccgtgactgtggaaagcaaccttgcccggttgttctgctcgtccgccgcagcctcgaagtatgagccggccagcagctgggcctccgcttctacggccgacctgacttgcgacaacaatctgagcaccaactggtcgaactggggcaccggcgacacctcgccgtggctcagctacaccttcgataaggcatatcagctgggcaagctcagcgttgcggtggataaggccaagggcgaggccgctccgaagagcttcactgtatcgtacctagctgaagacaacgccacgtggactgatgccacgctgccggcagtcactgtgaatggtgctgctggagccgtgacggaagccgatgtgagcgctctgcccgccaccaagggcattcgcctcaacttcacctacgccgatggcaatgactatgccaagatcgctgaagtacgcatcgccgaaggtgaagcaacgccaaagccgcagccgtctagtaacgccaatcttgctgatctgactgtggatggcaagacggttgacggattctccgcggatatcaccgaatatgccggtgcgctggccggagacgctgcttcttacccgacggtggaggcgactgctgctgacgcgaaggctacggtgcaggtggagcaggcttcgaccgagaacagcggcgtggccacggtgactgtaactgctgaggatggcacggcggaaacctacacagtgacattcggcgaactgcctcagttggccgagcttgctgtggaagcgaccaaggattcctatcaggtaggcgataagttcaacgctgccgatgtgaaggtatccgccatttacaaagtcggcgataccgaaacgctgcgcaagctgattgatccaactgatggtgatctgaagttcactggctttgattctgccaccgcaggcacgaagaccatcaccgtctcttatcgtggcgtgaacgcgacgttcgaagtcacggtcacggccacggaggtcactcccggccctggagagcagaagcccggcgataccaacaatcctggcaacattgctaagcccggtaacactgccacgaataagccggctgctaatggcgctgcgcccctttcgaatacgggtgttgccgtggctgccattgcggtcgtggttgtggtgctgacagctgcggctggtgccttgctcgtcatccgcaaacgccgcgcataaccatggcaactgctgagtggcgtggattgcgttgctattgagcaatctgcgattcacgccactcagcgagcgcacccgagtgcgcccgagcttgcgcaatgcaggcgcaatacagtgcaaacagtacaaagcaacaataatggccggtctgagccagctgctccatgcgagggcagctggctcagaccggccattgtgtctgcaagtacatgcaattagagcatgaacatgtggaagccgttgagcgttactggttgttttgctttgttgttgcgctcagcagtgcgacggacgtccgcccgcagtgtagtgcagcgctccgtgaaccagcgccgatgtgaaatgcatgttgcacatgcccgcttcttctgcttcgtgcgtgcagccggcgatgctgcataggttcataccccgaatcatggtcataccccctctttgggatggcatccgtgccgccatctgccttcagagcatagcggacaattgttgcattgcctaggcggtacaacgctttctgtggcctgtatcacatccttgccggcgttctgcggcgtggttgggcgtgtacatgtgctcttgtgcggttttgttgtgtgtgatttgggtatacggatagagtttcttctctgcagtggcaagggcctctcgaccggcgagccggctgatttctcccatgcgttgctcaatgatttccgttttgcgagtctgaacggcaaaatagctctggagaagtgccacttcttctttctttggatcaccgttttgagcaatgagatagcaggcgtatcgggagtgctgagttcgctggttttgcgtgtgatttcgtcgcggttcatgggtgtgtccttatgtttttcatgaccattttcgtgactccacgaaaatggtcaaagccaataattgcaatggttttgaggtatgggcgcgctccgcccaactggtctgtcttcgtccgccttttcgaccagatacctcatggagcacaatgccaacgtcgctaccgttggcccagcaaatattcttagacgacgccccgaagtgaatatctatgcggctttcagaatatcaaagagcgtggagtgtgtgcattatgcgttccaaaaatagtttctagtaatgaattgtttacggtgtgagatattcttggggtgtttgcggcgctctgccgtgtggcgaatgggaatggatggtgctcttatgggatttgagcaggaagcagttagtgaactgtatgccagcgtgtggggcaatcgttcgacaatgcagagggaattcactcgtggagcccatggtgagcagttcgtgctccgggagctgtccatgaaggggacgcaaacgccatcgcaattggcatcggcgctgcaggccagttccggccgcatctccactgtgctgtcgtctctggagaaaaaaggctgggtcacgcgtgacattgattccaaggatcggcgcattattcgcgtgaatctcactgattccgggcgcgagcagtctcatcggatgatagaggaaatgcgttccgcaatttgctggattttctcgcaaatgggggagcggcgcacgcgcgaattcgttgacctggtgtctgagttcaccacatatatgtcgatttgccatccggggcggcctcggccgacggctgaacaagtgcgtgaggcattcgtggagcgggacaagcgcgtggctgaacacatggcagctaagcgcgcggaggctgagcgagactagcttcctcccgctggcgggtctctccctccgtcactgctgcgcggtgacacctccctcgtcagagggaggtgaaggtaattgaggacgctcacagcgaacatacagaagtgcgtataatatctcacagtgtaagtaatcaaacaatggaaactattaagacatcgtgaaccgataatcaccgataacccagccaacttaagaaccaatcgccaataaccaataaccaacccaaccaacacaaggggaaaccaatgtttcgcatcatgaaatacctctccaaagcggagatcggtcagatgctcatcgccctggtgaccatcgtcgggcaggtctacttcgacctgaaactgcccgactatatgtcagacatcaccacgctggtcgaaacgccgggcagccacatgaaggacatttggattgccggcggcaagatgctgctcatctcgctcggatccgcggcgtgtgccatcatcaccggctacatcgctgcgcgcgtggcggcctcgttcacccagcgtctgcgctcgctcgaattccgcaaggtcgagtccttcggcccggccgagatgagcaagttctccaccgccagcctcatcacccgttccaccaacgacgtcacgcaggtgcagatgttcatcaccatgggcctgcagctcatcgtcaagtcgccgatcatggccgtatgggccgtgtgcaagatcgccggcgaaggcttcgaatggacgctcgccaccggaatcgccgtagtgattctgctggcggccatcgtcatcatgatggccatggtcatgccgaaattcaaggccatgcaggccctgaccgacaacatcaacctcgtggcccgcgagaacctcaccggcctgcgtgtggtgcgcgcctacaacgccgaggactaccaggaagccaaattcaccaaggccaacaaggacctcaccgacacccagctgttcaccaaccgcgtcatggcgttcatgatgccgctgatgaacaccatcatgaacggtctgatgcttgccgtctactggatcggtacctacctgatcgatgccgccgggctcaaggacaagctcaccgtgttctccaacatggtggtgttctccaactactccgtgcaggtcatcatgagcttcctgctcatgagcatggtgttcgtgctctggccgcgcgccgacgtgtccgcgcagcgcatcatggaggtactcgacaccgagccgatcgtcgagaacggcaccaaaaccgccgccgacgtggccaaaaccggtcagcgaggcaccgtggaattccgcaacgtcagcttcacctacccggattcgcgcgaggcgatgctggaaggcatcaacttcaccgccgagcagggccagacggtggcgttcatcggctccaccggctccggcaagtcgtctcttatcaatctcgtgccgcgcttctatgacaccagccaaggccaggtgttggtcgacggcgtggacgtgcgcgactacgacctgaaggccctgcgcgacaagatcggctacgtgccgcagcagtccgtgctgttcaagggcaccgtggcctccaacgtgagctacggcgatcagccgggcgacccggcggaggtcgagatggccgatacctccaccccggccgggcgcaagcgcgaggccgcgttgatcgccgctggcaaggctgcggaaggtgccgatataccggccgagcagctgaatcgcgtcagggccgccgccgacgtggcgcaggccagcgagttcgtggcgcgcatggacggcgggtattccgccgcgatcgcccaaggcggatcgaacgtgtccggcggccagaagcagcgcctgtcgattgcgcgcgcggtgtaccgtcacccggaaatcctgattttcgacgactcgttctccgcgctcgacttcaagaccgaccgcgaagtgcgcgacgcgctcgcccgcgaggccaaggattccaccaagctcatcgtggcccagcgcatcggcaccatcatgaacgccgaccgcatcgtcgtgctcgacgacggcaaggtcgtgggtcagggcacgcacaaggaactgctcgacaactgcgacgtataccgccagatcgccgaatcccagctcagccagtcggagcttacggcgtaggggggcggcagcggtagctccccatgtcaggggctgttcccaggcgaagacgagctgataagcgagcgaataaaacagcacagctgactgaggggtagtcgcgtacggcttctctccctccggcgcttcgcgccacctccttcatcagagggaggtcaatacggacttttaaggagtaaaacaaatgccaagaggaccaatgggcggcaggcgtgccgtcgaagagccccatgatttcggcaaagtcatgggcaagctcgtgaactattgccgcaactatcttcccgtcatcatcatcgcgctcatcctgggcgcggccggcaccgtctgccagatcgtcggcccggacaagctcaaggacatgaccaacgagatcgtcaaaggtctgcccgccatcgttaacggcagaccggtgatgaactcggtagatttcggcacggtgggccacatcgcctggactttggtggccctgtacgtgggctacgccgtgctcggctacgtgcaaagctggatgatggccaacgtcacccagcgcaccgcccagcgactgcgcgaatcgatctcggtcaaaatcaacaaactgccgctcaaatacttcgacaaggtcagctacggcgacgtgctgtcccgcatcaccaacgatgtggacgccatcggccagacgctggggcagtcgctcggctcgctgattacctcggtgacgctgttcgtgggcgcgctggtgatgatgttctacaacaacgtgatcatgaccctgtgcgccatcggtgccagcctcatcggcctgatcatcatgatggccatcatgaagtcctcccagaagtacttcgcccggcagcagatggcgctaggtgacgtcaacggccacgtggaggagatgtacgccggccacctcatcgtcaaggcatacaacggcgaggccgattcgatccgccgcttcgagaagtacaactcggacctctacgagtccggctggaagtcgcagttcctctccggcctgatgatgccgctcatgaatttcgtgggcaacttcggctacgtggtggtgtgcgtggtgggcgcggcgctcgcgctcgacgggcagatcgagttcggcgtgattgtggcgttcatgatgtacatccgcctgttcactcagccgctttcgcagtttgcgcaggccttccagaacctgcagcgctgcgcggccgccgccgagcgcgtgttcggcttccttgaagagccggagatggaagacgaatccggcaagcaggccctactcggcaagaactacatgggcggccacgaagtgaagggcgacgtggaattcagccacgtgcagttcggctacgagccgggcaagccgattatcaacgacttctccgcttcagtctcggccggtcagaaggtcgccatcgtcggcccgaccggtgccggcaagaccaccatggtcaacctgctgatgcgcttctatgagatttccggcggttcgatttcgattgacggcgtggacaccaagtccgtgccgcgctggaacgtgcacgaccagttctccatggtgttgcaggatacgtgggtgttccgcggcactgtgcgcgagaacgtcgcttactccaagcctggcgtgaccaacaagcaaatcgaggatgcgtgcaaggccgtgggcctcgaccacttcatccgctcactgccggacggctatgacaccgtgctcgatgacaagtcgtcgctctcccagggccagaagcagctgctgaccatcgcccgcgcgatggtgcaggacgcgccgatcctgattctcgacgaggccacctcctcggtcgatacccgcaccgaagagctgatccagaaggccatggacgcgctgaccgtgggccgtacgagctttgtgatcgcgcaccgcctctccacgattcgcgacgccgacatgatcctcgtcatgaaccacggcgacgtgatcgagcgcggcacgcacgacgaactgctggcggcgggcggtttttacgccgacctctacaacagccagttcgcactcgctgactgacggattgtttcctgcgttagcggattagcggattagctatactcggctcccctctccgaggggagctgtcagcgtagctgactgaggggagcaacccatcggtccacccgagggatgtgatactgatgatttcgtacattagtgtgtgaaaaagccgccgggaaaattgagggattgggcggcggtgcggttggcgttgagaatggcgcattcgaaggggaagtgagcgcgcagctgggtggccggggtggtgaacagggcggtggcgaggccgtcggccagtgtgacagggacgtgtgccgcaacggtgttcgacgaatcgtcggtatcgcggtttgccgttgtcgaggcattgctgccatgcgtcgatgtcttcgtggttatggcgctcgatggcggcgtgacggccacccatgtggcggctacatcgtcaaccggtagtccgtcgatggcgttgagcagatggtgaagttggtgacctgcggcgtcagaccagtggcggcggctgggggagctcgcgcagaatgcgccgtggctgatttcgaccgtacctacggcgttggccggatcggcaggatcttcaagggcgatggtgattggttcgtccgtatgcactagcaaatcacccccggcgtcgatgacgtattgaatgggttgagggtggcccgcgccatcgcccaacatccccgcaagcaaatccaccaaataccccttaccgcacgcaccaaaatcgagcgcgactgggctgtgggcgataagtgtggtgccgtgccgctcaacgtcggctgaccaaacggctcgtccgtggatcgcgcctgcatgttcggcggcatcgggcgtagccgcaaacgaatacgactcgtcgtagccaagccgaatcaaatcctcgcccacgcacgggtcggtcgccccatcggttgccgcaaacaggcggtcgtacaggccaaacagacccgatgcccagtcgggaaaatcgaacgtgccgccatgtgcggccgtgcgcatccggccgacgatggaatcatcgcggaatcgagataatacaacctcatattcatggatgaacgagccaatacgatcgcgtatctcatcgtccaatacgctctcggtgtgcaccagtaatccggtccccaacgcatcaggaaaagcgtatacgtatggcagttgctcggtcagacttgtcatgcccactatcgtagagcgcatggtgtgccggtgtatactggattttgacactgtgtcaatgttgattcggaggttgtgagaatgggcaatgcgactacagcaagtgtaacgggtgtgcaagttgcaccggcgaagtcagccatcagagatctccccatcgccaaagtgtgggcgtttgcggtcggccagttcggctgggcactgctttccggcattatctccaactggctcgtgtatttctatcagcccgatcaggagaccatctctcaaggccagaccgtattcgtgccgcaaggcctggttgtgctcggcatcgtgaccgtggtgggcggcatcaccgccttcgcccgattcttcgacgccttcgtggatccggccgtggcgtccctttccgaccgttgcgattccaaatctggacgccgtatgccgttcctgaaattcgccgccctgccgctcgcggtggtcaccgtgctcgtgttctggagcccgatcaacggcaccagctgggtgaacgcggcgttcctgttcgtcaccgtgatcggctactacatcgccctcacgttctactgcacgccgtacaacgcgctcatcgccgaactcggccacgactccaagcagcaactcaccatctccaccgccatctccttcacttgggtggccggcacggccatcgcgtacgtggcgccggtgatttggggcgcgttcgtgccgatgatgggccgcatcaccgccatccgcgtgaccttcaccatcatggccgccgtggcgttcgtgtgcatgctggtgccgccgctggccatccgcgagaaggactacgtcaactcccagcccacctccgaatcgaccatcgaatccctgaagcagacgttcggcgacggcgaattccgcaagttcgtatgctccgacgtggtctactgggtggccatcaccaccttccagaccggtctgccgttcttcgtgaccagcctgctcaagctgccggaaaccaccacgaccatctacttcgtgctcatgaccggcgtctctgtgctgttctatctgccggtcaatattctggccaataaggtcggcaagaagaggctgctgctggttgccttcgtgatcttcacctgtgcgttcgcatttgccggcgcccttggttcggccgtgctcggcttcattccggcgatggcccagggtttggtgctctcggtggtcggcgcgattccgatggccgcgttcggcatcctgccgcaggccatcgtggcgaatatcgccgacgccagttccaagaccaccggccaggaccgtcagggcatgttctacgcggcccgcacctttgcgatgaagatgggccagtccgtggccatgctgctgttcaccggcgtctccaccatcggcatggcgtccggcgcgggctaccgcatcgccgccgtgtgcgcggccgtgctgtgcggcttgggcggcatcgtgttcgcgttctacaacgagaagaaggtgttgggcgtgctggagacgtgatggcgttgccgggtgccgccgcggtatccatacggagcggtgtgggtgacttgccccgtctgcgacaccgaaacgttaccgtgtcgacacgcgtgcgacacttcggcgtcaaattgcgtttgaccgtactccgtactatattgttgcgagttgctttgcggagcaaagtaacatccaaggggctgtagctcagttggtagagcgcttcgttcgcatcgaagaggtcgcggtttcgactaccgtcagctccacgagaccctctgcattcattccaccgcagagggtcttttcatttgttttcgttgaaattctgccatctcgcgtttcaaggggctgatttggggtttgccggaggtctacttgcgtttcgaggggctgatggtcaagtagatacgccgccaaaatggcggaatagcgttgcgtcaaagccgtttgtatcggtgcttcaccggatgaggagccccttgaaacggaagtagacctccggaacatgtgaaatcagcccctgcaaagggagaatgcctcgatttcgccatggattgtcgtggattgctctgtggcatgggcaatactgggagtatgacaagcgcagatgagttgaatgagcagtatgacgctgacggtagcgtgacgcaagtgcctgaacgcaatgatgaagttcatgccggcgaatccgccgtcgcccaatcccgcgaatcggccgtgaccatccccgccggcaccgtggtgctcgccgccaccccgatcggcaatgtcggcgacgcttcagcccgtctggtggccctcttggaacgggccgatatcgtggccgccgaagacacgcgccgcctctacgatctcgcccgtcgcctcggcgtctatgtgaacggtcgcgtcatcgcctatcacgaccacaacgagcgcgacaaggccgacggcctgctcgaccaggtcgaaaccggcgccaccgtgctcgtcgtatccgacgccggcatgcccaccatcaacgaccccggcttggccatcgtgcgccgtgccattgaacgcggtctgcccgtcacctgcgcgcccggcccctccgctgtgctcgacgcgctcgccctctccggcctgcccaccgaccgcttctgctacgaaggcttcctaccgcgaaagcattccgagcgcgtgcagtatctgcgcacgctgttgcccgaacgccgcaccatcgtgttctacgagacgcctcatcgcattgccgattcgatggacgatctgctggacgcgttcggcccgaatcgcccgatggccctgtgccgcgaactcaccaaggattatgagcagattcgtcgcggcccgattgacgagattcgccaaagtgtgattgatgatccgccccgtggcgagatggtgctggtcatcggcggcgcgtccaacgaggaggccgaagcggccgcgcccagcacgttgagcgtggatgacatggccgtgctctccatcgaccgtgctttggaggacggcctgcgtatcaaggacgccatcgcgcaagtggtgcaggagcatccactggctgacggatcgttggccaatcgcaagcaggtgtatgcggctgtgctgaaaatcaagggatagcgcagcagccggcgattatctccccgttacgtttccatcgactcgaacaatatttccaacgcctgccggaccccgggcccaccacgctgcgagaccaattccagcaaaggtgcgtcggctttgggattggcaaccagccatttacgcagttcgggcacgtgatatgcgatgtgccagagcacggcaacatccgtatcgggcgaacatgccaccgcgggcgtaagtctgatgggcggttcaggcggcgcggtcatatccgagattgcgcgcgatgcggattcggatgagtgtgccgccgccgcgtggcgaggcaaccgttgcgcctgccgcaaatgccgtaaacggtgagcggcatggcggcctctgcgatggcctctgacaatgaaccccctcgtcatgcgcattgctccaaagccggttcgtccatctcctgctgcaccgattcaaaaaacatgcgtgcgcgtccggcgtacttgtgatgccgatgctccttgacgatttgcagacagtcgtttggccgaaactggtacgtggacatcagctgacacaccagtgcgttgacggtggaaggatcggggatgtcttcaggactcatcaccaggtcgcaagccgtacgggctggcgtggtgacaggcagcccgccgagcttgatgatttgctccggcaacgtcaatcttttgaatacgcggatacggcggctgacggatgccgagcggaagtgcgatgtggaaatcacgtctatggtactcggaaagtcggggcctcccagccatacccaagcggcggtcatcgaacacaccacagtgccaaacggggcgacctccgcgacgattttcgcgcgaccatacagtgtgcccgaatgctcgatccagtagccggcggaatcgtcgagcttacgtaacgtgccgaaggcggccagacggttaaggctgagcggtcccggcagatccttggtaaacagtatcggcggcaccgcaggttgcgcggttgccggcgaggcgactgttgtgatgtccgtcatcggacctgctgtgatatccatgaccgaacaatatgcagaaatgcggcttgcgcgccaccggataggcgaaaacggtggataagtgcataactttactaggtgtgcaaatgatgtggataactcggtggatattggcaggcggaagtgtgtgcggatgtgcgtgggcgtgcgtacggatgggtgcgcggatacgtgtgcgaatgcgtatgtggataagcgcgcaagaggtgtacagataagtatgtggggaagttgcgggtggataggtgagtgggatgaggatggcggcgcggcagctatccgggcgtgtccccgccgcgccggataatcaagccttatgagtcatgttttggtgaatgttgcttggccgtatgcaaacggcccccgtcatatcggccacgtcgcgggatttggtgtgccctccgacgtctacgcgcgctacgagcgcatgaagggcaatgatgtgctcatggtgtccggcaccgacgagcacggcaccccgattctcgtcgaggcggagaaggaaggtctcactgcccaggaactggccaaccgttacaaccgcgtgatcgccaaggatctgtgcgacctcggcctgagctacgacctgttcacccgcaccaccaccggtaaccacgagcacgtggtgcaggagatgttcaagcagtgcttggagaacggctacatctacaagggcacccagcaggtggcgattagcccgtccaccggccgcaccctgcccgaccgctacatcgagggcgagtgcccgatttgccacgccgaaggtgcgcgtggcgaccagtgcgacgcctgcggcaacgagctcgacccggacgagctcatcaaccccgtctccaagattaacggcgaaaccccgcgcttcgagcagaccgagcactacttcctcgacctgccggcgctcgccgaagccaacaaggcgtggctggagacccgcaagggctggcgtaccaacgtcatcaacttctcgctcggcctgttcaaggaagttaagccgcgcgccatcacccgtgacatcgactggggtatcccggtgccggtgaaggactggattgacaacccgaacaagaagctgtacgtgtggttcgacgccgtgatcggctacctgtcggcttccatcgaatgggcccgccgtcagggcgacccggagaagtggcgcgaatggtggaacgacccgagctgcccggcctactacttcatgggaaaggacaacatcaccttccactcccagatctggccgtccgaaatgctggcgtacaacggcaagggctccaagggcggcgaaaccggcccgatgggtccgctcaacctgcctgagcaggtggtggccagcgagttcatgaccatggaaggcaagaagttcagctcctcccgcggcatcgtgatctacgtcaaggacatcctcgcccgctaccccgtggatgccgtgcgctactacatttccgtggccggccccgaatcctcggattccgacttcacgtgggccgagttcgtgcgccacaacaacgaggagctcgcctcctcgtggggcaacctggtgaaccgcgtggccaacctcatcaacaagaacttcggcgagattccgccgctggacgaggattcgatgaccaacgaagaccgtggccttctggaagagagttccgccgcgttcgacgtggtcggctcctccatcgaaacccacccccagaagcacgccctgtccgaggcgatgcgtgtggtcggcgacatcaacaagtacatttccgccaccgaaccgtggaagattaaggacgaccaggctcgtctcggcaccgtgctgcacgtggccgctcaggccgtgtctgacgcgaaccacctgctcgcgccgttcctgccgcactccgcacagaaggtgtgggaggcgctcggcggcaccggcaccttctcgccgctgcctgagctcaaggaagtcgaggatctcgacaagcccggcttcacgtacccgattatcaccggcgattacgagctcggtgtgaacgtgcacccgtggaagagcgaggcaatcgaggtcggcgccatggtgcctaagcccgcaccgatcttcgccaagattccgaccgaggccatggaagaggagctggctcgcttcgatgaagcgttggctgctcgccgtgccgccgaagccgaacgtctggccgccgagaaggccaagctcgccgccgagtgatttggcatcgctagctcgtagctgacgggccacctcgcacatgaagtgttgcggggtggcccgttgccgtatgtgcggcctagccccgacaatgcgaggccggttgtcgggcggcgttacaaacccgtcacagtttgccaagacttttctcagacaagcacatcgaatccccaagaaagagacggttatatagaagatgtcaacggaatgaagttcataccggtggcgaggttcttccgaaccccataactgaacccttcttctctcttctctctcacccggcggccccctccgccgggtttcttcgttttgggccgcatcatgcaacgcaagttacgctgctgtccagctacatccacgccgctcgaagccgtgatccgccacaccaagcacggggcgcggtgattcggagcattgcttccggtttggggggtgctgcttgattcctctacttccagcgaaacgttgctatcgcggtatggtcgcatgcctgttaagcattgaagcatcttatctatgcgcagtcggtgtcccggtggtgacggcaaccgattgacgtgcgaaccgggccagatttcgttgtcccggttcgtgattttggcctccttttgggaaccgggacagaccatcccgcgagcgctcaatgtatgcaaatccagaagcccggaattccgccgatgtgtgatggcggatattgtgcggtagggccgaattggcgatttttcgagggtgtttctgtcccggttgctcaaaaagaggcgaaatggagaaccgggacaacgaaatctggcccggtacacacataaatcgattgacgtcgttaccaggacatcggacaccgtgacgtatatcgcgaaccgcataatatggcagtacgcaacgcagatgatgtgcggattcgccggacgtaacatggcgtgtgacacacaacagtgccatgcggtcggggccacgcgaccaaatggggtgcgatgaatggcatatgcgttgcagcaagcgcgcgcaatcgtatcgatgtcagctcagtgcgccccggtggatttccgtcgtttccgccgggcaagttcattgagcggcgtcgctgtcaaggtgaaatcgaatatggagcctcgcaacgccagctgtcgcccggctcggtaggcgagttcggcttgagacggttcatcagccatattcgcggcggtggcgatgaggacgatccaatgatgatgccgtaacagttcgcgcttgtcgttgtctcgccgccactgggccttgtctgtgcgatgatgatcgccgtcatattcgatggcgacgcggaattcgggccaagcgagatcgagtgttatcggctcaccattgctgaacgtcgcgccgggcactgtgtaatttgtcacggctcgtggaagcccgtattgcgtggttgtgatacgggtctctgattccatcggagaatccacgcgcggtgcaataaattcaagtgcgatcatgcatgtggctttcgcgttgaatttcggaagttcgctgacctgccgcacaaagtcctgataaatttcgtcggcggtgcggccgcccgataggctcggcttgcgcgctattgccgtaagggttgcgtcgccaagtatgaccaatgattccaatgacatgtgagcggcgagctgcgcccaagtatgtaccagatccagcgcgtgcacatgcttgttgatacgtgcattgtgcgcggtgcttagcggtttccagatgtgcggtgttgttggcggaacgacggcgcgtatccgggtgcgatgcgagtcggagacggtatggagctcggtggcattgagatcgcaatccttgggaagtggcacggattgcagtatcagcgatgtggtcatgccgaagagcacaggctttccgagctgttgcgcggcgtccgtgcatcgtttaagaatttcccgcttacgttgggtgagggtttcgctcatagcgggcgcagtgggggttgccatacgcggtggtgagtatggctcgggcttgacggcgtgcgtggacgcagcactcggtgccgcggcattgttggtccagccgggtggttcatcgtcgaatacgccgggtggcggggtgggaaatccgctgttcataacgccaccgtagcgtagcggtcgcttgttcgccatgaaaaacggggtatgtggttctagcttgctgaggatgtggataactctgtggataactaaagtgctcctatgttttgctcactctgtgaggagtcggcaaaacataggagcacttcagccgcggccaatagacggaatatatcagcggcagcgacgggtgaggggctgccagggatcgagctcgactggttcggtggtgagcagggcgcgggtggcgtcgtcgaggtattccttgcggatgatgagctcggtaacgtagcggtcgaaccaggcgtcggacatgacgtagtagccgtccttgccggcgtccttgccccagctgttctccaccttccagcggttcggcttgccgtcctcgccgaggttcacgccggtgaaggtcatagcgtggttgctcgggctgtcgccgtattcgaggccgtgggccttgtcgccggtgaattcggtgccgaacagctggtcgacgcgcaccacggactggtcgaagaaaccgtccttgcgcagggcgaactgcgtgcagtcgcaggcgaaccagatcgggtggccggcggtgagctggtcaagcgcggccttcttgaacacgtccagcggcacgttgacgaattccatatcgccagcctcggccacgttcgcgctgaagcggatgcggtagcgctggttgaacgggcggttcttgagcggggcgttggccagcgtcacgaaatcgttgacgtccaccggcacgtacttcttgtagaactcaagcggggtgatgccgatctcgcgaatctgcgggcgctcgtccttgccggttttcggcttgtcggacttgtccttatcgcacttgcaggccttggcgtcggatttgccctcgcacttgcaggattcgccgcacttgcaggattcggccttgccgtctgcgtcggcctcggccttgcacttgcgagcctcgcccttcttatcctcatcatcatccttggggcgcgcgaagaagtcgaacttctccggcggttcgccgagcgccacggcgcagatgcggtacacggtgcccatgtactcgtccttcaacgcacgcagctcgtcctcagacgcccccgcaaccgaacggcggcgcagctcggccgcgaactcgcgcagcttggagttgaggtactgcttgaaatcgtcggaattacgggagttctcagactccgggtaggcgctcttgggcactaggccgtacttgttcaccagtgcagcgaacatctgccaccagccaccatcgtctgcaggcgactcattgatggcctcgaacagacgcgaatcggtcgcctcgtcgagcgtgcgcagcacgttctccagataagtgttcgacttctccatcgcgtcccagaagaacaggtaggtctcggagaactcgaaatcctcaagattccagcgatgcatgagttcgtaacgcagcgtgttcagggaggcgaacatccagcaacggccggaacgctcctgattggtgatcgaaccctgcttgagttcgatggagaagtcgcgcggcagcgcacgcacgccgcgatagtcggtggccgccttgagcacgccggccgaaaccgccgcgtccgccgcgatcaggttggcgcggtccttgttgaagtcttcggtgtacgtacgcagaagttcgggtttgatggcccgtgcgctggcgtttgctgtcatgatgattgatcttccattcatgtaggcgacgtttgtggtccgtcggtagtataagtcgccgtgtattcgtcggacgattcaccgggcgaaatcgtacgggcggatatgcgccggcgattccaccccgccaacgatttgtccaccttgctgctcgcgcgggcgcacgtatcatatgtaccgatacatgttgttgacgaatgtcgcatagtccaaaggagtacgtcatgacttcgctgcatagcaagccgctggccctgaaaaacgtcaccgtcaccgattcattctggcgcaccgagcaggaactcgtgcgcacggctgtgattccctatcagtggaacgccctgaacgataacgtccccggcgcggcccccagctattgcatgcacaacttcaaggccgctgccgcgcaaaacaagcgcaaggatacccagggcaacgcgttcgtgccgccgaagtacacgttccgcggatttgaggcgctccccgaagacccggccaatcccgacccagacaagttctacggcttcgtgttccaagacaccgacttctccaagtgggtggaggcagtcggctattccctcgcccatcacccggaccccgcactggaacagaccgccgaccaagccatcgacgtcgtgtgtgccgcccaactcgacaacggctatctggacgcctactacatcctgaacggcatggatcgcgcgttcaccaatctgcgtgaccatcacgaactgtactgcctcggccacctcgttgaaggtgcggtggcctactaccagggcaccggcaaagacaagttgctcaaggccgcctgccgtttcgccgattacgtagacgagcgcttcggtcgcaagccgggccagctgcgtggttaccccggtcacgagattgccgagatggctttggtgaggctgtacgaggtcaccggcgaacagcggtaccttgatctggccgaatatttcgtgaccgagcgaggccggcagccgtacatcttcgatattcaggcagacgagaacgcaaagcgcgacgccgacgccaactacaaacccaacacggaccccaaccggtacgcctaccaccaggcgaacaagccggccaccgaacaagacgaagccgtaggccatgccgtgcgcgccggctacttctactccggtctggcggacgtggcccgactgaccgacgaccaggacctcgccgatgcggccgagcggctctggcgcaatatcgtcgataagaaactgtacgttaccggcggcatcggcggcacggtggacggcgaggcattctcctacaactacgacctgcccaacgactccgcctactccgagacctgcgccgcgatttcgctggcgttcttcgcccgtcgcatgctcgagctcgcgccaaaggccgagtacgcggacgttatggagtcggcgctgtacaacaccacgctggccggcatggcgctggacggcaagagcttcttctacgtgaacccgctggaagtcaatccgtatgcctgccataaagacagccgcctgcgccacgtcaagccggtgcgtcagaagtggttcggctgcgcatgctgcccgccgaacatcgcccgcatcgttgagtcggtgcaggaatatgcctacacggttgccgaggatggcggtacgctgttcacgcacttgtatatgggcggcgtggccaaagctgagttgaatggtacggctgtggagctggatgttacggcgaacctgccgtggcaaggcgatggcaaggcggtcgtgcgcttgggcggtgacgctgctggcacctcggctcaggctcctgctcgctttacgctggccttccgtctgcccggttgggtgggcgatgagtccgctgctgccgccgcgattacggccacgggcgagtctgagtctggggccgatagttcccgcgtgacccgcgaaattcgcgacggctacctgtatctgaccggtgagtggcgcgacggcgacaccgtgacgttcgacttcccgatgccggtgcgtatgctggccgccaacccgctggtgcgcgaggacgccggcaaggtggcgttcgtgcgcggcccgatcaccttctgcgccgaggaaaaagacaacggcgccaacctgcacctgctgcacgcggatgtggaggcactgctggccgacccgagcgcggccaaggtcgaggagttcgacttccacgccggtgctactggcatcgatgagcagggacaaggtgaggtggaagatgtgacccgccgcatggtgaagcttgaggtgccggcttggcgcgagccgttgccggctgctgtggccgccgcgggtgagggcgcggccgaggttccggcgttcgcaccgctctacaccgcctatgcgccggtcaagcgcgagcccgtcaccgccacgctcatcccgtacttcgcctgggccaaccgcggcgaaaacgaaatgaccgtctggctgcgcggctgatatttgctctcgtctactctggtagccatgggcatcacgacatgtcggctcgaagggccggtggacttttactcggtcgggcagtttgtgtccggaccgggctggcgccatctgcggcgcaccatcgacaccttcgagctgatgttcgtgcgtcggggcgtcctgccgatgcgggtgggggagcagaccctgcatatcgaggccggccaaatcgcactcttgccgccgaatgtggagcatgcgggcgccgacatcatcacgtctgacgtggacttctactggatgcatttcaaattgccggatgcgcgcatgctccccgatgacgcgggtctgccgcaggacgaccattgcctgttgctgcccgatgaacgcaccctgcccgaccccgaccggctggcggtgatgtgtgggcagctcatcgacatctatgcgcgattcggcccgtattccaacgcttactgcgattacttcgccaccggcctgctgctggaggtcagcgcgcaggagcggctgaaggcggactttgccgcccatcgtacgcttgccggctaccggggcgacggcaagcccatcaccagtgccgaccgcgtccggcagcaacaggaatgggccatgcatgtcgattcggccggtgccgctggcgattcgtccggcctggcgccgatgctggccatccgctcgtggattatggccaatgccttcgacgacatcaccgtggccaaagtggccgcgcgcttccactattcacccagctatctgaccgcgatgtaccggcgcgtgttcggcgtgggtgtggccgagcagatcatcgaatatcgcatcgaccgtgcgcgcgaactgctgagttctaccgcttccagcgtggcggatattgcgcgagaagtgggctacgccgatcccaagtacttcatgcgcgtcttcaagcgccgcactggcctgacccccggccaataccgcgacgctttccccgcccgcctctacaacaccgtgtgattagggaaggtcatggtcctaaccctaggaaaagtgcgcatgggtgccactaccacgtgggagcgctgggaacggtttgacgcatgccgaaacctcgcacgtcacgccgcacggcacttgggcagtgggcgcggcagtcgggaatcgccgccctatttcggcgtttcagcgttacctgtttgccgaaccgacagtggactcgcgcggaaccagtgtgtatccaatggtggcgcgcgtggccggcatgccagcggattcgtcggacctgccgtcgccctggtcgcgctgctccacgcggcgggtgatcatatcaagcgcgaattgggcgagctgatcgagatccacttggacggtgctcagcgtcggtgtggtgtacgagccggccgtggcgccgtcgaagccgatgactctcacatcgtcgggcacgcggatgccgtagtcggcaaggcctcggattactccgaatgcggcatagtcgttaatgcagaagatgccatcgatggccggggtgcttcccgttgcccgcgtggtgcccggggaacgggactcagcagtgtcatcagccgattgcgcacgagcctcgagcatcgcctcggcgatggcatgaccggcttcgatgccgctgtcgctaccgtaaccaatgaagttcgtcgattcgtcatacggcagcccggcatcgagcaacgcgccgctggccccgcgcaggcgcaaaccgctggaactttccacgtgcgccagttcggttcgtggcgaatacccgtcgccgacgatggcgatgcggtggcatccgcattcgatgagatgctgcactgccgcccgcgcaccgtcctcgttcgggaaattcactgtatcgaacgtgggcgtttcctcgcaggcgtcaatcagaaccagcggtcggccgtggttgatcgcggaaagcggcacaccggcattcaggcccgaagcgtggataatctcgccgtcgaacaactgcccggagaacgggttgttggccagcgcgtgtttggcggcatccggagagtaccgggtttgctccacgaacggcgtcagcccgcgctcggtggtttcggtgacgagcgattcgacgagtttggagtagaacggcgaatcgaattcgttgacgatgatgtggatgatgttgctgcggccggacttcagcatgctggccgtcagattgatgcggtaatcaagcttttcggccactgccagcactttggcgcgcgtggaatccttaacacccggcttgccgtgcagcgcattcgaggcggtcatgggggagaccccggcggctttcgctacgtcgcgcaatgttggtttgccgctcggcataacgtcacctcatgtttcgcctgtgatgggcattggatcatgcccgtaatgcttccaatggttgtaacggtattcacaacatcgtgttttggcaaatggtggctgtgtgccggaatcgctgaaaatgctgcgcttaggcgatgacgcgccgagcgtaacatgcgcttgcttgatatcgttccggtggaagaatatgtaacggtacatacgtcggtgtgccaagaggccatgaagttcgtcgtacgttgggatgggactctccgggggagtggcgtcactcttcacctatccgtacgtgcgcgatgccgattggtttgcggctggcgtaccgccgtatggcaacttatacgaatatcaacgaaagcaggatacgatgacggatcttccgcagagccttcctcaggcatggcgtccgccgatgggctggaacagctgggattcgtacggcacgactctcaccgaagacgagctgctggccaacgcgcggttcatggctgaacacctgaaaaacgccggctgggatacgttggtcatcgacatcgactggtacgacccgaccgcccgcgcacatggttacaacgacaacgcgccgctgattctcgacgaatacggccgccagctgcctgacccggtgcgtttcccgagtgctgccggcggcaagggattcggcctgctcgccgccgccgtccacgaactgggcttgaagcttggcatgcacatgatgcgcggcatcccgcgtatcgctgtggacaagaacctgcccgtatacggcaccaactacaccgccaaggacgtggccgacctcgaccacgtgtgcaagtggaatccggacaactacggcctgaaccaatcccacccgggcgcgcaggcctggtatgacgcgcagctcgacctgttcgcctcctggggcctcgacttcctcaaggtcgacgacatgcagaccccgttccactccgacgaaatcgccgcctatcatcgcgccatcgccaaagccgaagccaaatacggccgttcgattgacctgtctctctcgcccggcggctgggtggcgacgagctacgtcgacttcctgcgcgagaacgcccaaatgtggcgtatttccgacgatctgtgggaccgttgggaagacatctaccagcagttcgcccgcttggcccgctgggcgccgttccagaccaccggccactgggccgacgccgacatggtgccgttcgggcacataggcctgcgcgccgaacgcggcgacgaccgccaatcccgccttacgctggacgagcagaagacactgctggccctatggtgcatggggcgtagcccgcttatggtcggcggcgatctgcccaccagcaacagcgacgccatcgcgctgctgcagaatcccgcgttgcgtgaggtgcttgccggctccaccaataaccgcgagaccgtgcgcgaacggatttttggcaaatggtgggatgagagcacctaccgtggcgagttcatcgtctggtccgccgacgcagccgattgggccgatggcacacgttccgcgcatcacggcggccattacgccgcgctgttctggaccggcagcgacacatacgagatcggccgcaacatccagctccaatccatcgtggggcttgacgcccgcaatgacgattggacactcgccgatctgtatgccgacgcgccgggcgagcccgccgacgtgcgtcttgaaggcgtgggtgccgaccgcgtcatcaccggcacgattccgccgcacggcgtgctctgggtggtcctggaccgacgctgaaaccgaacctgcctccgccaaccaacctcctgaaccgaccgcccgaatcgtatggagaaacctgccatgaatgcgaacatcgcaaacgaacaatccccggtagctgttccgcccgcaagttggttcctacgtgcgttcgctggcgttctgacctgtaggctgtctgtctctgtctgttcgttgtcttcgccttgcttgcgttttgtacgttttatctgtttcgtgagtttcgtgcgttctgcggatttcacgcgtttcgcgcagcgccgcacgctgatcacaattcagcgtgcggcacttttgcatatctcacgtgttgcgggagatgccgattccgtcgcacaatacgtaaaacgtgaatgagccactcactatgctgggttgtttgagcgtgatatgacatgcgccactttcccgggaatgcgttgcgaattggacctgttcggaggtgtgcagcgacgcattccggggaatgttgcgcttagagagccgcgtatcgttgctaatgcggggaacacgcagagttgcgggccgttgcgattagacgcaggctgtctagactagtacgcgtttgcgaaagtcgaacgtgcttcgaccgatgaaggagagcttcggtcatgcggccaatgacaggcgcagtgcgaagcacggctgatcgtgaatcgcggcggcagcgattgccgcgtgcggcgcaggagcatgccgcaccataccacaagcaaacaatccccaagaaacggtgatctcctcacatgtacgtcgatccgggaatcaataccagcgcaagcaatctcaaatgggtgctgccatactgcaaaccagacctgccccgcgtggtaggcgcgcttctactgttcatcgcaaataacacgatggccctgaccattccgattctgtccggtatcatcgtggaccgcgtcatcgtcggcggacatgccgacgaactgccacgtttgtgtggactgatgatcctcatgaccatcatccgcgtgggcgcgcgatacggctaccagatgtggatggagcgtttcggccagaactcggtctaccgcctcgtctccgacgaatacgagaagctgcacgagctcgacttcacgtatttcaaccacacacgcaccggcgacatcatgagccgcctgacctccgacaccgacgcgatccgccactgcctgagttgggtgagctatcagattgccgactgcgtggtcatgttcgtgggcgccctgtgcgtgatgttcgccatcgattggcgactcgcgctcgtcctggcctgcgtcacgccgttcatttttgtgctcacgcgcggcctgtccacgcacgcccacccgctgttcttcgccatccgcaactcgctggcctccctcaactccatggtcgaagagaacatcgagggcaaccgtgtggtcaaggcattcgtgcgcgaaccgtacgagaccgaaaagttcgacgagcacaacgacgattacatgcagtgcaacatggccttggcctacaactcgcgcaagtacatgccgtggctggacggcctcggtttctcgctgcagctcatcaccctcggcctcggcggctttctggtcatcaagggctacatgaccctcggcaatctggtgagtttcaactccttcctgtggatgatcgacggcccggtgcgccagtccggctggctgatcaacgactggcagcgattcaacgccagctgcatcaaaatccgcaagctgctcaccgaacagccgcgcatcgtggagaagcccgacgcggtcgaagccgtcaagcaggcggtcacgatcgtcgagcaagtcaagcacgatgatgaggctaccggggctaccggagcgcccgtggcttccggaacatccggtgcccagcagtccaccgaacgcaagtcctgcccgctgcacatcaagggcgacatccgcttcgaccacgtcagcttcgccttcccggacgacccggagaccccgatcctcaaggacctcgacttcaccgtgcccgccggctccaagctcggcatcctcggcgaaaccggcgcgggcaagtccacgctcgtcagcctcatctcccgcttctacgacccgaccgttggccatgtgctcatcgacggcatcgacgcacgcgactggccgctggccaccttgcgctcgcaggtgtgcatcgtggcgcaggataccttcctgttctccgacaccatcggcggcaacatcggttttggtgccagcggtgatagcgacgaccgatatatccagaaaatggcccagatcgccggcgcggacaatttcatcaggtcgatgccacagggttatgacaccgtcgtgggcgaacgcggcgtgggcctgtccggcgggcagaagcagcgcctgtcgctggcccgcgcgctcgcggacaatccgtcgatcctgattatggacgatacgacctcggccgtcgatatggagaccgaggcggagatccagaagcacctcaaggagatggacggcggcaagaccatcgtcgccatcgcccaccgcatctcgtcggtcaaggattccgacctgattctggtgctcgagcacggacgtatcgtcgaacgcggcacccacgccgaactcgtggccgcacacggccgctactgggacatctaccacaagcagctcggactccagtccggcgtcgcacaaggtttttagaagaggacttatggcacaacgcaatacataccgcgaggatgaggaactcgaggagcagatcaacttccgggacatcctgcgcgtcggcaaatatctcaaaccgtatatggcacaggtggcgcgcattctcgtcgtcgtcatctcgatgagctgcatcgtcgtcgccgtgccgtacctgaccaagatcatgatcgacgaggcgatcccgaacaaggacctcggcaagctcggcatcctcgccgtgatcctcgccgcgctgatcgtgctgtacgagttcgggctgcgctaccgcacggtggcgatcacgcgcgtcggccagctcatgctcaaggacatgcgccgcgatatcttcacgcatatccagacgctgcccttcagctacttcgattcgcgcccgcacggcaagatcctgatccgcgtggtcaactatgtgaacacgctttcggacacgctgagctccggtctgatcaacgtgatctccgacgtgttcaccttcgtgatcacgctgatcgtgatgttcgtgatcgactggcagctggccctgtggagcctgatcctgttcccggtgctcatcatctgggtgcgcgtgctgcagatcttccagcggcgcgccttccagaagctctccaacaagcagagcaacctgaacgcctacatccacgagtcgatcgccggcgtgaagaccacgcagaccttcgcacaggagcaggcccagttcaggaccttccaggaacagcagggcgaggtgcgttccgcgtggatgcacgccgtgcacatccagttcctcatgtggccgggcgtgcagaccatctccgtgatgaccatctcgttcatctacttcgtcggcgtgatgggcttcgggggcgtgaacgtgaccaccggcgtgctcatcgcgttcgtcggctacgcgaacaacttctggaatccggtgatcaacatcggcaacttctacaaccagctcatcacctgctcggcgtacctcgagcgcatcttcgagacgctcgacgtcacgccggagatccgcaacaagcccgacgcggcggacctgccgcagatccgcgggcgcgtcgacttcaacgacgtggtgttccgctacgagaaggacggccgcaacatcctcaacctcgtggacttccacgtcgaaccggggcgcacaatcgcgctggtcggcccgacgggcgccggcaagacgacgatcatcaacctgctgtcgcgcttctacgacgtgtccgagggctcggtgacgatcgacggctacgacgtgcgcgacgtgacgctcgcatcgctgcgccggcagatgggcgtgatgctgcaggacaccttcatcttctccggcaacgtgcgcgagaacatccgctacggcaagctcgacgccaccgacgaggaaatcgaggcggcggcgaaggccgtgcacgcgcacgagttcatcatggaactgcccgacgggtacgacacggtggtggaggagcgcggatcgaccctgtcggccggccagcgccagctcatcgccttcgcgcgcgtgctgctcgccgacccgcgtatcctgatcctggacgaggcgacgagcaacatcgacacgcgcaccgaggaggcgctgcaggccggcctgcagcatctgctcaaggggcgcacgagcttcatcatcgcgcaccgcctgtcgacgatcgagaacgcggacgagatcttctacatcgatcacggccagatcgtcgagcacggctcgcacgcgcagctgctcgccgccaagggcgcgtactaccgcctctacgagtcgcagtacgcgatgattcgcgtggccagcggggcgccggaagagtgacgagatgttgcgcacaaggatgcgtttagcggcgtttcacatagcgggtgctgcgaccggcaccgattttgatgatcgtaccggagtccaacagtgatttcagcgtgcgctcaatggtggtggtgctggtatcgggcatgcgagcgagaatatcggccttggagagtggaactagggattgatcaagcagtgcttcaatccgcgttcccttggtggctactcgcggtgctccctgcgctctgccgcctgccgtgagattgatgcgttcgtcgaattccttgcacgcggacagtatgatgccaagcaggtagttcgtgaatggcgcataatcattggcgttgtcgtcccagccttgggtgcttgcggccagcgcctcataataagtgcttttactttgctcgataaggtgttcgatactgatgtatttgccgaccatatagccattgcggcacagcatcaggagcgtgagtagccgactcatacggccattgccgtcattgaacggatgtatgcaggtgaaatcgagaatgaacatggcgatggcaagcaatggatcggtatgtccatctcggattgcttgcgtgtaggcggaacacgcgcgttcgatcagtattcgatgtagtcgaatgatctcataccgcctcattttctgcatcatacgaacttttctgcatcatattttatcaagatgaggcagaaaatgggctgatgaggcagaaaaggcggcaggatggcggccatctcgcttgacgattgcgcgattcttggcgcggtgctgctcggctggttcgcctgtgcgatgatcgtctgctggattatttccgctcacctgagtatcgataagcgcactgattccatcgttcttgctgaaatcacccgtttgcgcaacggtggtgccaaggcggacgtgaccgacgatacccgtcgtgtagtcgaacgtcttaccggactgccttacgagcgttgctgacggtagcctacactgagaaacagcttacactgagaaaccatgagcaagcaccaccatcgcgaccgtagctgggccccggcacctgaagcattgccggacgacgcccagaccatcgacaaccacactcacgtggcctccgtaatccctttcgcgcgcgctatgagccatgaggcgcaggagaaggggcagcccgaagtcccggtgtacgacgtcgaccaattgctggcgcaggcgcaatctgtcggcattgggggtatcatcgactgcggttgcgagctgccgcacctgatgaccgccgtccagatggccctcgatcatccaggtaacgtgcacgcggcgctcgcaatacaccccaatgagtccgtgctccacgggcatcgcggtgtgccggggccggatggtctgcctctcaaatacaagccttaccatgacacgtctttcgaggacgcgctcgccgaagtacatcgcctcgccaccacataccccgagcaagtggtggctatcggcgagaccggcatggacctcttccgcaccggcgaaggtgccaaggaactgcagcgcgaggctttccgcgcgcatatcgccctggccaaggaactgggcctgcccatgcagattcacgaccgcgactcccatcgcgaggtcatcgaaaccctgctggccgacggcgcgcccgaacgcaccgtattccactcgtattccggcgaccgtgagatggccgagatcgcgcgcgaacatggctggtatctgagcttctccggcaccgtgagctacaaaggcaatgacggtatccgcgaatcgctgcggattgtggggctgggccatgcgatggtcgaaaccgacgcgccgtatctgacgcccatgccgtatcgtggccgcaccaacgcgccgtacatgattccctacaccttgcgggccatggccgatacgctcgacttgcccatcgcggatgtggcgcgcggcacccgcgataccgcccgcgccgtatacggactgtgagggccgggtgtgcggccgtcgcggcgcgtgtagagacgatgtgttgacttgtaaaatttgtcagaattgtgaacgaggtctatcatgatgtgtttgacataagcgagggggatgatctccacctcaatggaggactgaacgtatggctgagtcgaaccaaaggaccgcacgcgcccaaaaagccttaaaggcccagaaagcccagtctggcgccgccaaagccaaggcccgacaggaagaagaagcactgctgagggccgacacctttaccaacgctcccaaggtgtcccgccgcactctcaccaaggaggagcgcgaggcactcgccaagcagagggaagctgaaaccaaggaagccgagaaaatcgccagcgcatggtcgaaaggcggcctcggtcgatggtgggcccgcctgcaatccagcccagacaaggtcacctggggcatggcaatcgtggcgctcggcgtggtgtacggcgacatcggcacctcgcccttgtacaccgcgcagaccttccttgccggtcagggagggcttggcggcgtagaccgagaggccgtgctcggcatgctgtcgctggtcttctggtcgattacgctgatcactaccgtcaaatatgtgctcatcgccatgcgcatcgacaacaatggcgaaggcggcatcttcgcactgtactcgttgattcgcaagtacggcgcatggctcgcgattcccgccatgctcggcggcgcggcattcctcgcggattcggtacttaccccggcggtttccatcagttccgcagtcgaaggcttgcagaccctgccgccattggaagggttgttcgacgaaaacccaagcctgaccctgatgatcaccgtcgtgatcatcgtgattctcttctccgtgcagtcgcgcggcaccgaaagcatcggcaaagtattcggctcgatggtgctggtctggttcggcttcctcgccatcgtgggcgtcacgaatctctctaacgactggtctgtgtttgaggccctgaacccggtgtacggcatcaaattcctgttcagcccgcacaatgctgccggcatcgcccttatgggcaccgtgttcctctcgaccaccggtgccgaggcgctgtactccgacatgggccacgtggggcgcggcaacatctacttcacctggccattcatcaaggttgcgctggtgctcaactacttcggccaaggcgcgtggatgctggccaatagcgataacccgcaatacactgcgacggagtcactcaacccgttcttccagatgatgtctccgaacgtacgttatctggccgtgattctgtctgtttcggccggcgtgatcgcttcccaggccctgattaccggcgcgttcaccatggtctccgaagccacccgcctcaattggatgcctcatctgcaggtgcggtacccggcccgcacgcgtggccagctgtacattccggtggtcaacggcgtgctgtgcgtctccacgctggccgtactcgccatcttcaaggattcggaacacatctctgccgcatatggactggcgttgaccattacgatgatcaccaccaccgtgttgctcggcgtccacctatggcattccggcaagcgggtcggtgccatcgtgttcaccgtgctgttcttggcgattcaggctatgttcttcatcgcgtctatggccaaattcctgcatggtggttggttcaccatgttgctgaccgccgcgattctgttcgtcatgtacacgtggaatgagggcaccaagctcgaacgtgcgcaacgccgtcacatgcggcccaacgacttcctacccgcgctcgacaagctgcacagtgatttccgcatcccgtattttgcggacaacatcgtgtacctgacctccgactcggaaaccaagcgactcgacacggacatcttcttctccatcttcgccgaccaccccaagcgcgcccgtgcttggtgggcagtcagcgtggaaaccaccgacgagccgttcacccgtgaatactcggtggaggacttcggcacgaactacatctaccgcgtgcgcttccgtctgggattcaaggtttcgcagtccatcccggcgtacatccaccagatcatgcacgacctgtccaaaaccggcgaactgcctaagcagaagtcgatttaccccaaggtcgacgccgatccggacatcggcaccatccgttacgtgctgattcacaaggccctgatgccggaatccaaggtttctgcacgcggtgccctgtcgttgcaagccaagtacgcaatccgccacatggccggctcgccggttaagtggttcggtctggcaccttacaacccgttggtcgaggtgcagccgctgttcgtctccacccgccgcccaccgcgtctgaagcgcaccgatacggccaagaccatcccgacgcccacgccgactcgtgcagtggccgacccggccgccgtccctgacccgatggacaccacgtccgggcttgggcgattggtacaggagctcgatgccgccgtatcggccgaggcgcggaagaccgctgaggccgctgccgccgatgcgcccgctgagcagggcgataagggcgataagggcaaggccgagaacggcaaacccgccgccaagcctcagcgctccgccaaacagaagcgataacataccagtttgcagcggcgctgatgcgctctataaagaatgcctataacggtcgccgcacgtcgccacacggtttcggtaagttgaaataccatgtgcagattactgggatacgcgacggcaggcttcaacctgagtctcaacgctgtgttggggcaagacaatgtcgaggatttccgtgaactgtctgaaatccacaatgatggctggggtgtagcccagctttccgatcctgccgaagcaccgcacgtgcgcgacggtggcgcacccaccccggaaaccggcacccgaatctacaagtcgaccatcgcggcccgtcatgacagcacgtttgaggcgctggccgacgaaccgtctcgcggtgccatctggcacctgcgcttggcaagttccaatctgccgctcatcatggagaaccagcacccgttctatgcgaacggcctgagcttcatccacaacggcgatatctcggacgccaatggccgcaacatcgtcaccaaccgctcatacccggtgaaccacagcgtgttcctctccaccggcggccgttccgactccgccatcttcttcgcggtgattctggaatacatcggcttcggcttctcgctcgacgaggccgtggcccaggccgtgcgcgaactgcgccaagcctacccgaagtccagctacaactgcatgattcagtccgaggaccagctcatcgccctgtgcgccgccggtcgtgagaagaccagcccgcgcatcgtggaaatctacgatgagtacggccgtggcgagcaggccgccgactaccgtgtgatgcgctaccgtgagctgcgcgacgacaacggcgactccgccggtgtggtggtctcctcttccggctacaagcaggaaggctggaacgtgctggagaacgaccagatgatcatcgtctccaaccgcaacggcacctaccgtctccgttccatctgaaataccttcataagccccctctgacgagggggctgtcagccgacaggctgacttggggggagacccctagagcctcaaatcatccgcatcccatacttctccgccaacgccggaatatccggcacgccatacttggctaccagatccagccatcgctgtttgttctctccgccaaatcgctcggctcgggccgtatacgcctcgacctgcaggaacttcggcggcactgacttgctatggaacttgtcggcgtacatcaccacttcctgctcgagattcatcggcacatagtcggctggtggcaacggcagctcctggcgcaccacatcctcgcgcgtaagtcccacgccggtatggttgcggcagaactgggcgatggactcgtccacgccctcgtcgagcagatactcgtagcccttaagaccgtgcagaatgtagcgtttcttgctgaatttgagcggttcgccgtcagagccgtcatgcttgaacacgcggtaggtgccgatgtcatgcagcagtccgccgatgagtaccaaatgctcgtcgagcagacgcggcggcacatggccgccggtgacgcctgtggtgggcggtacctccgcgtccttcggtaatgtgcagcggcgcgtgaacagcgcgttctgccggcgcacgatctggcagccgatggtcgctacaatcacgcaatgcgtgtgcaccagctcgtacgccgccttggacggcgcgattttgcggtgcaattcgtcgatctgctccagtgtgggaatatatccggtcataattatcaggtttcgcctcgtacggtcagatttatcctcagattagcgcggcaatgagccgcagcattgaaaaacccctgcgattcggcaatacgaatcacagggggctctatggtctgaacatcagatttcgaagagtgtgtcggctgcttcggcgatctcgcgcgacgcagtgagcacgataacgcagtgcttcgggtcaccggtgtgcgccagcttggccagcgcggcgaacacggtcacctcgtcatccgcgttcagccctcgtgtcggctcgtcgaggatcagcacctcggcctcggtgctgattgcacgggcgatggccaccaaacgctgctgcaccaaaggcaatgtgccgacagccacgccgctggtggcctcagagaagccgaccttggccagcagttcgcgggcgattaccggcttgggcttcaggaagttgcggttggacgcattcatggcgtacagcacgttttgttcggcgtcgatcttcggctgcacggcgtgcagctgcggtacgatgcccagacggtggccgcgcagttccacgggctcgagctcaacaatgttggcgctcttgttcatcaccgtgccagacgccggcgtggtcaaaccgctcatcacgcccatcagcgcgcgacgcttggcgtcggcggtgatgcccgaatcggggtcgtcgctgatcagcagcgcgtatgcgtgtccggaatagcagaagaaattcgcgccatcgaggatgttgaccttgcccttgggtccggcgaccgtcaccttgttcagggcgaaggtcgggtaggtcttgagcagaatgtcgtcggaaccgccgcccaccaacacgcgatcgatacgtgaggccagcgtcatggtgggttcggacgctttgccctgaggctccgcatgctcggccaatgcgtctttgtgatcggttttggccagtcggagtgtttcgttgacgcgggcggcattgcgctcggtcacttcggcggatgcgttggccgaagcgatggcgtctgcttcggcctcgctggtctcgtcggtttctccggtttcggcagatgccagtgcgctgtaaataccatcgtcaacagtgccttcgtcatcaacgtcatcgaaggtcacgctgaactgcatggagtcagctggaacggattcaatggcgtcgttcgtctcagtctcagaagtcgcttcgtcagccgttgcgtcagtggtcttctcgagttcctgatcgttgttcctgtcgctcatgcctgtgcctccgcatcgtcggttgtggtggtcgtcttgttggtctcgctcacggtgccccagtcgccatcggcggcaaacagcttgttcgcgctgaagaacgcaaggcgcagggcggcaagaatcgccaggatcaggattgaacccagtccataccagaccatggtccaaatcaggcccgatgtcaccggggtggcatggccggatgccagggcagatccgatcggattggcggcgaacgcgcctccgaccagaccaatcacgtagaagggcagggtgacgatgaacacttccagcatgaactgccatcccaaacgcccgcgagtgacgccggacaccagtgccatgccgatctcgtcgtcacgcttggacgcccacacgcccgacagcacgaggatgagcaacagcacgccgcccacggcaaccaacacaatggtgccggtcttcgcgcgcgaggatagcgtatccagcggctccagagaagcgttgtaggattccagcgaaggggaagagaactcgtaacccttggcgggcagcttggacttcttgagggtggataccaaggacttgtatgtagcggaatcaccggcgtcgaacaccacgtccagatccgggactgcccagccggagacggtcttgtcggtggactgtgggtcgagtccggccttggcgaaggtctgatagttggtgaagatcgcgttctcgcggttgcgggcggccgtcaccggattggcgacggcggattcggatgtgtacttgtagatgccgcgcaccttgagtttggccgtggtcttggcgtccgaggcggccgccacctcgagcgtatcgcccaccttcaggttgttggcggaggcaaacgcttcagagaccagtgcgccggtggtgttcgggttggaggactggttgttgtagctcaggtccttgccgtccacgatttcgaaggtgccgaggtcgctggccttggcggaatccttggtccagaaggctcgccaaatgagctggccgccggtctcgtcatcggaggccgagcccagcgatccgccgtccagggccttcaaatcaccgctcacgcgggccggcacggtttcggtaaccgtgaagttcaacgagttggtggccgactggacgagcgtggcgtattcggtgtatgaggtccacgtcatgtaatgcttggtggaagccgagtccgtagcggagaccttcttccacgtagccgcagtcgggcgaatggccaacgtggccttctgctgatcgtacgcggtggtgtgtgcgttggtatcttcttgaatgatggccagtccggcgactgtgccgaaggtgaccgccaaggtgatgaacgcggtcagggccgtacgtcctttagaacgtgtcagggcccgccaggcgttgctgaggacgaacatgtaattacctctcccgttctcctaagccgaacaaatcaatacggctctaactattgttgcgtttagtgaccgttttcttgcgcaatactgttatacccctcaatgaagtctgagaacattctgacagcgatgtggtagtcatgcggggatttgcacccggtatgggataaatcctcggtctatttcggtggcatcggtacactggcatgagatatgcgtggcgtcacgtgtgctccggcatgtctgcgattccggatttgcccggagtccggcatccggaagcgtggcctcgcgccgctggataagagtatgagctgagcagattttcgggcagggtaagtatgcgattcacttcagggcattcgagccataaggctgtggggcgtaggagaagacgtcatgccggtaacggaaaattcaatcgctccgcatctacgaatagcgctgtgaatcagcagacgggtcccgtaaacctgaagactccccagcacgtgggtggtaacggccgttcgctgatcagccgtacgccgatatgggcgcgagtggtggttgtactgctgctgacgttgctggccagcgtcacctgtgtgggcacgctctacgcggcatccgtctcgagaatggccacggatgcgcagcgtgtactgacatccgccgaaagtctggccaattcggcacttggctgtggcagcgataagagtctgtcggacatctcccaagagctggtcaatgccaccaatgatctcaatgcggagctgaacggcccacagtgggacttcttccgcgaccattcgcgattcggaagcgacatcaccgccgcccgcgaaatgctggcttccgtggatacgctggtcaacggtccgttcactgatctgctgaacctgtccaaccgattgcagggcttctccctgaagaatggctcggtggacgtcagcgccctgatggatatgccggatatcgtcaagcaggcgcataaggatatctcgcagcagctcaccaagctcaacaaggtgccgactccgagcgtcgccaaggtggccaccgtgctcgaaaccgaaaaggctgcgctcaagaccgtggattcgatgctcggcgaatacgatggcctcattaacatgctaccgcaactgcttggcgaggacggcaagcgcacgtatttggtgatggtgcagaacccggccgagctgcgttcggcgggcggcatggtaggcaccatcgccgcaatcacggcagataagggcacgattaccatcggtgatttcgccaccacttctggttgggacattcctgaggagccaatggatgatacggtgctgaaggagcgccaggtatttggtggcacttttgaccagtacccggccaccacgaccatcgaccccgaattccagcgtgtggcacagatgaacaaatacatgtggctgtatcagaaaggcaacgaagacgagaacgtagcgggtgtattgtcactcgatcccgtatttctccaggcattgctgggagccacaggcgaggtcaagctttcggacggccgagtgctggatagcaccaccacggtgccgttcttcgcttcagacctgtacacggattacccggacttcgagcagcagaacaacttcgtttccgaagcggctcaagcaattatgaaccatgtgcttggcaacgcgaatgcctccaccgcatccccgctgttgaaggcaattagagataccagcgctagcggtcatttcaagctatggatggctgatccggatgagcaggaggcgctgattgccaccggacttatcgacgataaggccagtggcgagttgtctgctgacagtcaggtgcccgaagccggcatctatctttcggagctgcagcaaggcaagcaggattggtatctgaagacctccaccacggtcaccaaaacctgcggtgacgtctcggccagccagaacgccctgtattctggcgtgctggataagcgcatcacgacagccgtgcgtaacacgcagctggggcagtttacggaagatcagctcggtgacgaatacacggtcaccttcaccatgaagaacacgctgactaaggctaaggccgaatcgttgcctgatttcgttaatggcggctcggagaatccagtgctcggcggcatgttgtaccgcgtggtgcttaccgccccgtacggtggcgaaatcaccgctgtgcaggctgatatagattcatggggtaccaacaccgcgagcctgtatgaccgtcagtacattatgttcaaccagcagtggatcgagcccggaaaagaattgacgattgcttataccgttcgggtcagcagcgatgccacacatccactgaacgtggtaaccacgccggtggtgaatgcggatggcgtcgagacgggctccaacggtaatgtgaccgatgagtgcacggcggatacgaacggcgccgatggtgcgaacgacgacaagaacggcggcgcggacggcggcaggaacgatgcgcataaggacgcgtcctccgatccctcggccggcctggacaccttggacaagctgaagagccagatcagctgcccggtcgatctgaagtccctggcgggatccatgtgatgaccatgcccgattccgtttccggcgtcgccggcaagccgcgcgacgtgaactacgatctgctgcgcgtggtggcgatgtgcctggtcatcggcgtccacgtgatcaacaactacatgcccgtcaagatgaccctcgccggcagcgcggaagtgacgcgatccgtactgttcgcgctgttcatggtctgcaatccgctgttcatcatggtgtccggccgattcaacctgacattcgatgccgcgcaaggcgccggtcggccccgacccaatggtctcgcgccgtacgcgcgctactactacaaacgttttatctcgctgattgtgccgtatctgctgtatgcgggcggcatgggattcgttgcctacctggtgattgatcatcgttcggttggcggcgctgtgtctggaacgttgttcgatctgttctccgggtatgacgattccgtctattggttcgtgttcatgcttgccgggtttgtgctggcaacgccgttcctggccgcgatgatgcgtacgataggccgatcgggagcctggttgctggtcgggctggccgccgccgtggccgctgccgagcatatatgcgatcttgccggatatccgttgacgttcctgcagtcattcccttggcgtggactgctgatctactacctgttgggattcgtgttggaatactatccgccgtccgcgcgtatacggcacggcgtgtatgcgttggcaccattcgccttggcttggaccgttgccacgccatatctgttcgccggccagcagatgcaggttggccgcacggtcacggttgcgttcgcgatggtggtaatggcgacgttcctgttcttccggtacgacgtgcacatcacgtcggcgcgggtgcgtaaggcgattatctggctggctggatattcctacacgatttatttggtgcactcgccactgtccaaggtgctgattggcccgcggattcccgcgcccacggacggatggtcgtatgcgggtatcagcgtgctgatgtttggcgctacgttgctggcggcgctgttatttgcggtgattgccgataccgtggtgcttaagcccgtgcagcgtctgctgcggaaggtacggctgtagattcggatacggcgctatgccacggtatcaaagccaggaatcccagcagcagaagcggggtgaacgtgaatttcgacatgccaaggccggcatcaaacggttcagccgcttccacgcagcgctcgccgctactcgcgagaacacggtcgaaggagcagaaacagcatcagaggcatcggaagcatcagacatatgtcccactatatatgaggtgttggtggtgattgagcgatatttgaaggcagttctggaagggtcctagacgtatgatttggagaacggttccaccattaatggtgtcaacgttcagttctattccagcaacggtactaatgcccagcgttggatgttgcgtaagtaggtttgatgagcatgacttcatctgatgagaagccttgaacccgtgtccacatttatgatggagggcgaataacatcaacgatttttagcacggctttgtctccgtcatttaatttcttggcgctgtcgatgccgctcgcacatccacacatgaaaagagccatgtcaatcatctgtagcccgtacagcatgcgcgaatcctcccattggaaaggcattttgatgcgtgccaaatcagaggggaaatatccttgcttatccaaggtatgagagatttgtggtacctgtggctggaaaaggataatgagggactccgaaaggatgcttaatggtaggggaggaagaacggtatatcgattcaatcggcttgtcgtatgtggacggataccgattatgcgcttgaggttggtgcgcgtattgagtgtgtggtcgaacaagctgaagatgagtgggggtgtcattgttgacgttcaagaaagcatggcagataccaggtaaatgatttacctaccttcatattttgcggtttgggctgacactaaaagatggggtgcgactcacggttgcgccccatcttttagtacgtcgctgtcagtgcctcttgttgtatgcgattttgttggtgtcaatgacgaaagtcttgcggtcattcttggccatgacatccaggataataccggcgatgatgagcagaagaccagcgatgaccagcatcaccgcgccgatcagcgtggggaagtgggtgaccacgccggtcttggcgaattcgaaggtgacggtgccgcagagcacaatgccaacgatgccgatgattaggcccaatccgccgaagaaggggaggggcttgtattcgcgaatcatgcggaagatggtgctcatgaccttgatgccgtcacctacggtgtccagcttggacactgagccttcggggcggtcacggtactggattggcatctcgtagagtcgcaggttgttgttcagcgagtggattgtcatctcggtctcgacctcgaagcctcgcgagagcacgggataggtcttgacgaaggtgaagctgaacgcgcggtatccggtcatgatgtcggtgacgtgcgcctcaggtgttgcaaccaccactagaatctgccctgtttttgtcgtgatgcacagtgttcctgtttattgtctggtgttgaagcctgctggtcttgttttgccggtttttacatcgtggcattgtttgcataggcctcgtccgaacttcgggtcgttggggttgagtcgcatgtcaatgagttcggttctttcgtatgggtaatggtctgcgattgtgcttggattgccgcagagtccgtggtgtttgccgcagcctccgcgtccggagtcgccggggcatgtgcagtatgggtctcgtgcgagcacttgcctgcggaatgattggtgccccttggtgccgtaggggttatggcctcgggtacgggtgcggtcccgttgggctcgggtgcaggcgtcgcatttgcgtgccggtgtctcgatgaggttcgggcatccgggtgtcgagcagactcgccagctcatgtgtgcctcgcagtcattgtgtccgttggcgtgtcttggtgtcctcggcttgcatatctatagttattgtgttactatagatatgtcagccaaggaaaggaggtgaacatggaacagatcgcggagctgctcaaggccatcggggagttcctctccggattgggtgcggcactcgcacccatcgccgccgtggccgtcgcattgattgcgaagagcaagccgcgaaagccgctgaacagacggcgcaagcggtaacaagagccgtggattccggataatcgtactatccagagccacggctccactcccaactattccatggaacatcatgaacggcaagataggaatcatcgcactcatgttcggagtcgtcagcctcgcgctggccatcgcatcccagagcgtaccggcaggtgtgttcggaatgtgctcgggcgtgctgggttatctggcaggaagggcaagcaatggcgactgaatatctcggcgtcaaacaggtcgcagaacgccttggcatcaccagtggcggcttgctcaacctcaagctccctgagcccgacgccacgatagggcgcacgcgcggctggttgcctgagaccatcgatgaatggaacgctcaacgtccgggacgtggtgtcggaggggggagaccacgcaaaaacaaagcatagatacgcgaaaacccagccacatgagctgggtttttcgatactaatccactgacattatgcggtcacagtcagctctttgtcaagtccgccactgatgacgagccggtagacgctgctgtatgaaatgccttggggcgtgacatcaagcttgcctcgggatttccacacggtgagcgtatgccttttgacggtgattcccgcgtccgtgaacaccttggctatctcagccgcagacccgcgcctggaatcatcccaacacaacgtcttgagcctacgcagtttaaccgtctgcgctcgctgttccctcccgcagaccgggcatgtcacccactggtctgctgccccagcggtgagcatggtctcgcatagttcgcaggttcctatctcgcggcgttgctccggcgggtccagcgcagcatcgactttgcgtgcgatgccgtcaacgacgtgcatgtagaagcccgcgtccgcgaacgtggcgagcctggggtggcctgcgcatgcgatgagcgtggccttcagatcctcgttgcgtttgtctttgcgccagtccaaggcgtcgatgccgtcgaggcaacgccatagttcacgggccgtggcgtcgagcatgtcgatcaggtcgagcacgtcaagcctgataggagtcgggggagtggccgtctggattcgcgtgggcgaatgcccgcccggatgcagggtcgcgtccaacgagtcatgcaacggcgtgacgtcgcgcgccagtcgcaggagcgtgccggcgaaacgcagttcgcacgtctcgcacagtgaatatcccccttcggttatcgttttgcagttctggcagttcacgttagccccttccggctggtcggctagaatagtgtttgcttctcgccctggccgaccttgttggctggggttttctcatgcttgagctggctgtacggcatatcccatatgcgtttgaattcggctatctcctgtttcgacagtttcggcccgccccacggtttgcccggcggccgctcgcggcttggtggtttgaacggtttgacgcttatccgggcgagatggcacatgtgcatggccagatactggctgtccggcatgatgcccgcgctgccgcatgtgctgcgcaacaatgggtgtcctacggagggcagccatgtgacgcgcgtcactggcctgcccaagatgatggccacggtcaggtcgtcacccgccacacacccgtaatcccacgactcccatacggtttcgcgatcctcgatgacgtacaggccgcacccctcgcagacggtgacaacgaggggactcgttttcgggatgaacgtgcgcagccatgctggtttgcgttcacgggtgcgtggcctgttcactcctccattgcctttcttcttgccgcgtcgaacgcgattctgatgatgttctccatccacgcgccggggagcgtgatgaactttctggtttcgtccatggcggcggcaatctcctcttcagtgatttcgcgtgacgctccggccttgtatccttgtccccaagcccactgcaggccactgtcgacgtacgacgggtcacgctgcttctgtgcctcgatttcactgctgatgatgctcattcgtttcctccgtttcgttgttgattgcagtttcgattcgtatgcacagatcgagcgctccccgccagccggcctggtagccgagcacatacgcctctgccggcgactcgctgcccaatcccgctgaggccagtgcgctgagcgcccgttgaatcacgtcaatcggttcggccatgggtcagtcctcccatttgatgtcctggatttcatgcagcaccgcttcgcaggcggtgatgagtacgctgagcatacggcggccgtgatggcctctccggtcgaggttgaacaggtcgggatggccttgactccactggtcgatgctgatggaggcgattgggatggtttcgaccagattggtgtcagcatcctcgcagaggtattggatggtgacggattctttcatgctttctcgctttcggtcgtgtaacagttcgcgtcgagccagtcggcgatggttcgaaagtccttggcccactgaatccgcgtctggcgttcccgctcgtccttggggattggcttcggaatgtcaaaatcgagtaccgagtattcggattgttttaggaaatggctgcgggctggtctgcctcgatgctgagggacttgcctgtagttgacgatttggaggatgtgcagcatctccaatgccttggccgggtcgaagttcggagtgtcgggattgtcgtcgaaccgctgacgcagctcgggcactgtgccttcgccgttgccgagttcccatgcggtctcttcgatttgctctctgaatgtgagtgacattttgggctcctttggtttgggaaaatctagtgtcgttgaggggtgtttttggtctttccggaggggcgagccgtagtttttcccacacccggacacacacgtagtgtgtccggggagtgtggggaaaaactagactcgatggctcagtttttccgggaaaaactcggaaaaactgggaaaaacgggaaaaactagatttcgaggtggttttcgtcatccaattcactcgcctcctccctgctcatacggtccacataggcgtcggatttcgggtcgtctatctgccggtacggtcggacggatttgaatatcgaacgattgttgcgtccagagcggttcgagacgaaaccctcctgcaggagcaggctcacggctttgctcatgacggcggtacgcgctccggaaccgtcttccttcagtgccttgaacagttcggactggttcggttcttcgagtgagtcctccagcatgcggctgatgcgttccatcagtccggtgggtcggaagtcgtcgcgtttcgcctgtcggtcttcgctgggcatcatgttcggtcgtgcgatggtgacgcgcatgagtttcgggtccgtggagttgatttcgatgcgtgctgcttcgcgcaggtgcgagccgttcgaatcccagctgacggcgcaatgctcctcgatctcgctgatgcggtctttgcctgatttgatgacgatggtgccgcgcacgcccttgccgactggtttggtcatgtccaccgagtagctgatgccgtcgatgagtgcgagtttctgcatgctgccgccggcgtagcggccccggttgtccttgcttttgatgacgtggtcgatgagtacgactgctggcccacaggcgctgatgagtcgtggcatggtgttgtaccaggctgcgatgtcgtcgccgctgttgctgtcgaggccggcgtaggcgaggcagctggtgacgccgtcgatgatggccagcgtggccgtgtccgcgtagtcgagggtttccttccagccgtcgaggctggtggggctgctcggcttggcgctgggccgcacgtagtgtaaatgctgcacgatctgttcgccggtcacgccgagcagcaggagacgcttgacgacgtttctggcggaatcctcatagtcgatatagatcacgtcatgtccctgtttgagttcctgggcggtggcgatctgggcgagcatgcttttgccgcagccgggttcgccgtgcaggtcgttgaccgcgcccctatagaagaggccttggccgtcctctcgttggaacacggtgggcgtgggcggcagttcaatgccggaagcgagctgggtgaggtcttcgaactgccagctggaggaggcgtttttacttgcctcgtgactttccattgaaccgttttgaaccgatgcgacgggtgttgaaccggcttgaaccggcattgttccagtgttttgaactgcttccgggtgactttcctccatttgactcgcagccgcgttttgggtgagttcgtcgaactcgccgggcgtcatgcgttcgattttcgactgctcgcacggatccacatgcgattgcacgccgttgaccttctccatcgcgccactgagaatgctggcccattcgcgcgccgcctcacgctccttgccttgacggtcgggggccacctcggcgatgaaccgtggcttcaattggctgatggcgtcgagcgctccacgatggccttcctgcgcgaagttcaccaacgcccagacggcctgcagcgtggtgtcatgccttgagcctttgcttgccgggttggcgagcgtcttgttgaggaacgtgttgaccgccttgcacatgcggtcgtcgtatcccctcggattcgagggggttaaagtgttcgaattcgaacactttaattccttcgggttcgacatattgtcgggcttgcgcagatagtccacccacttccatggcagtgtcgccagatccgagatgtgggggagtgtgctggcgaatgcgccgcttggcgtgtaccagcagtacatttcgccgctcgggtggatcgacggccagaccacggaataccggtggccgggctgcaggatgtccaccccctcgatggctccgcccttccaggcgagcccttcgggcaccttgtagaacaggtggcgtgccgggctgtcgatgccgtgcgccgtgctgctccacgtggccggcaatacgcccagttcctgcgagagctcgctgatgcctttcgccccgtccgccttgacctgatggccttgtgcggcgtcgatgtccaacaccaatacgccttcggggatgacgattcccgtgttcgcgtccggggtcgcctgcgaccagagccgtatctgctcgtcggtgacgggtttgcggctgcgtcccgtgaacccgctgggcggcggggtcttgcggccttccggcagggggatgacctgcatccagcccgccgcacggtacaggggtgcggccgtcgcatagccgtagatgtcggtcattcctgaaactcctttgacgtgatgtgaaaatgtggttggtgccgtgcacgcctttgcatacgtgccggccgcttggatacggctacggcggtcgggactggtatcagtccttgtcggaatccttgctcttgtgccagcccaggagcacgagcctcacgctcatgagctgcaggctttccgagtcgacgtcacaaaaaccgtcctgatcggaggcgagggaatccatgtctttcatcagctcgagccactggttctgcaggtgtttcagcagttcgtccatcagaattcaccggtttccggcatctgttcggaacccccgtggtattggggttgcgcctggtcggtgacggcggtgaccgcttcgaccggcacgcccaacaatgcggctatctcctgcgggcttttgcccacggccttcaactggttgaccttcatcggatcagcctgctgctgtggctggccgagctgtaccggctgggcgggttgctgcggctgctgctgcgtcggcgggttccatgggtcgaccggagccggcgcatatccctgattcggggcctgcatgggctgctggggcgcgtactgctgctgcgggtatgccggctgggcttgctgcatgccgggctgctggggttggttcatggcgaggtcggccggcgactggtgttcgatcacgtattcgaacagtttcggcgcgttcatgccgggcttcgcctcgccgaaaccggtgaacgtggccgtgaaacggtcgccaggccgcacttctgcggccttcctcagcccggcgttgtgcaacgcctgaagccatgcgcggcgctggaggccgaagcccttgatgtacacggtgcgccggccgtcatcgtcctccaccatcggatcggtgacgccggtgttgatggtgacgagcacctgcatctgcggctgtccgtcatcgaagaacttcggctggcgggacttgaaatcgcggatctggttggcggtcacgttctcgatgattccgctgatcgatgtgccgggctgttcgaatttcgcgcccttgctgctctgcgattcgatgctggcaagcatctgctccggggtcatggacacggccgggcgtgccggcggctgaccatacccctgctgatacccctgttgggggtaaccctgctgcgggtaaccatactgttgctgtggctgtccgaacatgattgttttcctttcgttattcggtgaactggtattcggattcgattagggggatgagttggagccatttgtcgggcacgtccggccacggcttctcgtcgaactcgggaagcgcgctcatatccggccagacccggcccttgcaggagaagcacttgtcgggtccggccgccggcaactgtttgatccagctgtcgcgcacgtcggggccctccgcctgctccacgcaatccatgaggttgacgagcagttgggcgcggctcaacgcccatttgccgggctccgggtcgaacctcgtctcccaaggcaaagcgtcgcccaaactggtcttgttgctgggcaggaagtaaatgcagttgcgttccacccgttcgccctcgttctgcaggcccatgccgtagagcgacgcctgtatccggtattgttgcgatgggccgtgggccttgaccttggtgacggtcgtgttgccgacgttcttccaatcgatggtgctatgggttttgcgatcccagaggtcgatcgaaccggtgacgtcgtagccgccgtgcaggccctgcaatcggcctacggtgacgcgatattcgctgcgccagcgctccacgagttcggtcacgttgtcctcactcgtgtagaggaactggtgcgcaggatccctgttcagctcgcggaacatctgctcgaagtgctcgtgcacgcacgtgccgatgaacggccgccaacccggcgaacgacgctccggccagcccgccagtttcgccgcgaggcaatgcacgcaatccgttcccagttcggatgggcctatctcacgctgcagctcacgcggagcgttctggatatccgcttcgatgagctggcggatctccggccacaatcgcggtccctccatcgtgtccgtcttggttttcggcgttgccggcggcttgtccatatcgggtgccgactgcgtcatgggcggcacgtcgacgggtatcgcgtcaccctgctgttgggcttgtgctacggcgagaatggcgtcattcatgctcatggttcttcacctccttgagaaggtcgtcgatctgtttcttgatgtcgcccagtgcggtctggctgagccgtataatggccaccgcctcgtccgattcgaagcgcagcgtgtaggtgcggtcgccgtcctccgcgatggttaccggcatgctgccgaaggccatcgaatgcacgggaaaaccggtcttgccctgcgcctccagttcgcgtatggccttgtggatgcgtctggcgacggtgaggcccagctcgtcgagctgctcggaacggatgacgtacaggtcgtcggtcagctcgttgccgtcctcgtcgtgcaggtcgtagtcggcgataacgctttccacgatctgggcgatgcccaggctggacagttctgcgttcatgagaccaccaccgtcggcttgccgctcatcgcgtaatcggccaccgcgtccgccgacagcagcttctccaactggctgagcggccgcggccgcaactggtaggctccgggatacttggtggccgggtaggctttttcgaacgtgccggcgttgatgcggcgcgcgcccggcttgacctgcaccttcaggttgccggcctggtaggtgccgacaggatgcgagtcgaggatacgggccttcagctcgtcgacctcctcctgacgggacgcgatctcggcctgcagttcgacgatgcgcgccgcctgcgcggcgaacaatccttggcgcaattccccgtccgggttcacggcctctgtgttttcaatggttgatggagtcatttgatgtgcctttcacggtgatttgggcgtaggtgggataccacgccgtctgatgcttggtctggttcgtgtgccggttgcagcaggtgaccgcctcgtccagtccggtgggcttgccgagcggcccgcatgtcctgcaacgcggcatccaaagacgccggtcaggcatcctgcctgtccttggaggtgagtcgcagtccggcgatgatgtccgccgaagcgtccgggttgcgcagcagcttcgatatggccgcgccttccttgacggtcagttgggcgatggcgatggccgacgtgacggccgtatgctgctcgttggtgagcatgatcttgtcggacagcaacagtttggtcgcccggtcgatgaacgtgctggccgcgttcgtgatgccgttcgccgtcggcaccagggccgccagttcgaaactcagatcctcgtccgacaccagcgcctgctgcaccatacgcggctcgttgataggcttgctcatgattgtttcctttccttcggctcccattcggggagcggcttgattcggatatagagatgtggttcgtattcgtgcccgcagtacgtgtacgggtcgccggacttgcgtttccggtatttgcctttggctccgtacacccacaggtcgggcatgcgcttggtggcgtgggattcgacgacctgcgcgtcatccacgtaggcgacgccgttcaacgagtccaaaaccagcttcaaaaggttgtcgagatccggcctgcccctatgggacatccagaattcggcctccaacctgaccgggcactggtatggtttcgcctgcgggtatttcaaccggaattcggcgaacaggcgttcctccgccctgacggtgcgtttcggcgtcatcgcgtgcccgttgtagacgcggggacgccccttcggcaccgggtcgcccggcagacagagcgtgaactcacttggctgttccatcagcgccccacttcaacaggattcccacgaacatgagcggcaggatgaccgccaatgcgagcgagccggttatcatccactgcggcgtacccaccggacttgggatgcgactatgcgtgccggcgaaaccgaccagccaaccctcgaagaacgtgagagccagtaatacggccgatttctgcccgtccgttaacctcggccggggtcggcgcatacgcttctttttgcgcaatgcttcgatgctcattccgcaacctccttgcgcttgcgttggatggcacgcagcagggtcagcgactggctgaggatcatcgacgcctcgaacgccaactggttctcacccagctcgaacagcgcgtgttcgagagagccggccgcgtcatgcacgtcactggccacatcgacggcgtgctgccactgatcgaccggatggaacaatctttcctccacggtgtccttgtccggatcgcacaccggacaatcacacttgccggtttccggctggcgcgtctcctcgtccaactccttctccaactcaacctctcctccctcaagcagccgctccatgagctccttgaatgacattcccttcgggatctcgacgccgatggcgtggattccggtaatcttgtgtcctgacatcacttgtcttcctttcaatgtgattggtgatgttggtgccggcgtgaaccttggacagtgcgacgccggcacctcttccttttctcccggttttgaatccgggaaacccttattcgccgtagaccagctccttgcggcttatcgcgcaccgccggtcccggtagtcgatgacctcctgtggattccaaacgagcctgcggcctacgcgtttcggcgcgggcggataccggcctccccacttgtcgtggcacgaccacacgtagagactgcccttcgagacaccaaggaagctcgccaccttggcgatctgccagccgtcaagagacgattcgatttgactaccggccatcacgcacccgcttccaagtcaaggggagtacagcccagatacttctggatgaggtactgctggcccttgggcgtgaccttcgtcgtgaagttcaacgacacatgaccatccgaatgggcgatcgatgtttccttgacctcgaacaaccccagttccatgctcttctgcgtcggcatgttcggattcccgttgcgcttcatcaggaaaccgtcctcacgcaattgcttgaacaaccggttctggccggtcttcacgccgttctgtttgaggatcttcgccaattcgccgatcagaatgctcctcttgctcgtggccaccgcgtccgcgaacaacaccttcggcttctgctcgtccaactgcttccgttgttcttcgatggtcttctgcgcgatgagcaccgcgcgagccatcgtctcctccggggtctcgccctggggaatgtaaccgccggtacgacggatctggggcactacctcgtcgaacagccaatgctcgaactcgaccgcgctggtgagcttgctgctggcgatgaggcggtacacgtcgccttcggtgatgaacacggcctgttgggtgcggccgaggctgtcggtgatggggtagcgattcgcgaccccatcgatatgacggcagtgcttcctgattgcgtcacgggtgttgctgtatccgagtgcggtggcgacgtgcttcgcgcagaacagcaccgtcccgttcccggtggtcaccgtggcgaccgggttgccccgaaactcgaagggctgtacattggattcagtcattttggaccttctttcaatctgacattcgccgccgctccaatcggcggcatttttttgtggctagaatctgagccatgtggaaatggctggcggacaactggatgggattgacggcgttgctactgtccttcgacgcggaacgacgcctgtacctctcgaccgattggggagtagagaagacggatggggacgggtggatactgcgcaacaacgggtggctcaccgaacgagacattcgggtgacgccgactggcggcgctatcgtcgaataccgtggagcctccaagctcaagcgccatgagtccggcaccgtcatcgtcgcgatggtcgagacctcgaaatcgagagacatccgcgtatcctcgcgaagaatcctgttccggcattcccggatcctgtccctatagaccccggcccgacatccacgggctcgagcccacggagacagaaatcgatgtcttccttgtcgcagacgacgagtcccgtgtattcgacccagcatttgccgtcatcaaacacgcgaaccgtcatcgggtggccgtccaaccatctgacacgatccatgtcgatgctgagaatacgaatcagcgcacgggccctctcacgttccgcgccgccaagccggtaggtcctaaccatcactccaccgcctcaggtttgagatccttgtccggtatttcggtcacttcggctatttcacctggcgtgaagccgaatgcgcggttgaatccgacaatcatcgtcggggagacgatgttggtgtgcattgctttcgacagcacgctttcgctgacgccgatagcgccggcgaaagccgcattggatttcagcccgctcatgcgcttgcagcgctcgaggaaatccggtttaaaggtcatcgcgtaagccatctcaggcaacctcctttcagtggtttgcatctcgcaaccttggtgttgcgttctgcgaattattaaaatgcacaatgcgaaataagtcaagcgaaatgcaaaacacggcgtgttgcaaagaaacagaaaatgttgcataatgcaaaacatgaacattgaacagtggtaccaggaaacagtcggaaacgacagtcaaaacaccgtggccgacaatgcaggcatcgtcccatcgtctctctaccgacaactcccagataagttatccccgcaaaacgtggtaaagattgcgcgagcttacggtggatcagctatcgacggtcttgtcgcggtgggtcttatcgatgacgatgatttgagaaaatcagaatcttccgacgctcttcgtgatgccacagatgaggagctcattcatgagctggcaatcagattggcagcaggagcagcaaagcggaatcctcgatggaatgagcctatcgtgatttccgatgaggatatgaacgaagctcgtctacgcaacgaatcaagcgagaaggactctgattcagatcttcggcctatttccgaagtagatgacatccctacattgtccaaagataatttcaagcaatcaaataagaaaacgaagcattattcaagcatcggagaagagctggcagagaagttcgcggcaaaccccgaaacctttgaggctgccgccaatcatgaccggaacaaggagcttgaaagggaagggggcgaaggacgataaacgtcacctatgacgacctcctgagggaagcctccaacagcggcattcgggtggaggaatgccagctgcagcaggggttatgcggcttctactatgaacccaagcacctcatcgttatcgatgagaccatgctggatttccagaaacgctgtaccctctgccatgagctcgtgcacgcccacaaccacgaccaaggctgcagtccctacgggtcgaaagccgaacgccgcgcaagactatataccgccctgcgtctcatcaacccgcatgagtacgcgatagccgagcgcatgtacggtgcggactcgtacctcatcgcatgcgaactcgatgtgaccgtacaagtcatagaagattacaagaactggctgcacgacagtgtggtcgtctagaagaaagaagagaaccgtgaccgagccaacccccatgcaggcacagcagccgccggcaacgcaggatagccagcccgcagcagcaccatccgcgccaacgccggcaccgaagaagaagctcccaacggcggccgtcatcgccatcgccgcagccataggactggtcgtgggactagccggcggactcggaggcatgtacctgtacgccacgcccatcatcaaccagcagaagtcggacatccaagacctcaatacatcattggactccgtcaaagcgcagctagccgacgcgaacgaaaaactcaacccccaggaagatcccaacgacacgggatccaacaccgacgcttcgggcacgggggagaccgccgtcagcggcggcgtcgaaatgaaggtcctcgaagccggcgaacagcccaccatcagcttcgacacatgcggcgacggatgcagcaacggccaatacgggccaaagacaccggacgcgaacaccaagtactgggtggccaaggtggaggtcacgaacaacaccagcagtccgatggacatcacctgcagctacccctatgagatagtcgcgttgaactcgaagaaccagaaatacacgcccatcaagaatctgtatcaggtcgaaggcaaccccgagtgcaacgcccagctccagccgggattgaccagcacggtcacctatccgttccaggttccattggacgcgaagatggttgccatagcattccgcgacgtcggagacgtgtattccggcaccggcggggaggacaactactcctatatagtcaccgacccgaattacgtggtcaatcgatagaaaaagaattgccctgtcgatctggaacatcggcagggcgtgtgaaacatcgaccagcttgcttaattggaaaggaggatgcttcgcctccccatcatagccgataggcctggcggagctatacccgaaatgtcagaagaacgcgagtgtgctgccgaagtagtttccgcgctcctgcggggtaaactccagggacagcagatggtattccgggtcgtcgggatccggcccctcgtccatgaatccgaatcgtgtgaacaggtccatgctgggcttgttgcgcggatccacctgggtgagcacgagtggcgtgcggttgaaacgccaggcatcgtcacgcaggcgcacgataaccgaggagagcagagtgtctccgagatgtgtgccacgcaccttcaaagcggtggcgatatacgagatctggtagacgccctcatgctcatcggtcgtttccacggctacgccgtattcgcagaagccgaccacgtcatcatgcaggggaatatctccggatacgacaagaagcgtgcgcatgatccccttcggggtcttgcgcacgctgaggtcacgtatgtagcgttgcgggtccatcgcccattcggggcctccaggttcacagcacaggaactgcctgagggccgtctgatggtctctggagcattcgcgctcaatgacgagcttcagacccatcgatggtttccttccgggcctttgccctgcgttccatgtaatggcgggcgctgcgggtcagcttcatccatttctcgtccacggcgttgcgtggcttgccgtcctcgggcggcacgtatgccggaatcggcttcacgccggtatcggtcatggtcatggccgtctcctttccgattttggcgtaaagagaatattttattaatttccctgttatccgtcaaatctcattaaaacacattaataccagttaaaacacgttaaaaccgaaaacaagtatgagcgagtgaaaaaatcatggcgaacatcaccagatacaggacggccaaaggcgaaaacaggtatcgagtccgctatcggaaacccgacggcacgcaaaccgacaagaggggcttccgccgcaagattgacgcggagacgtgggctgcggaacacgtcaccatagccaaggccaccggcagctacatcgacccggaaggcggcaaacaacgcataggcacgctgcatgaccagtggattgccgaaaagaagccgttttggaaggcgacttcgggttccaacatggacagcgcatggaaatgccactgcgaggccaaatgggcagaacggcagataggcagcatcacacacgccgaagtccaggcatgggtcggaagcataatcgataagtccggcgcaccatccgtcagccgcccataccagatcatgcagggcatatgcagcatggctgtgcgggacaagctcatctcctccaacccgtgcgacggcatcgaactgccgagactccccaaacgcaaggatcgccgcatctacctgaccattaccagactgctggcactcgccaacgaagcgtcgaactgccggaagctgggagaggagcgccgggcgctcatactgctattgggcttctgcgggctgagatggggcgaagcggccggattacaaagacgcgatctcgacttcgacgccggcatactgcacgtgcgccgcaacctcgtatacgtcaacgccaaatgggccgagggcaccccgaagaaccacgaacgccgtgacgtgcccatgccccgcatagtcatggacgcgctcaaaccgatatgcgagcaacgcgaacacgaggagcgcgtgttccgtgacgtgcgtggaggccctatccgcaagcagagcctcgcccgcgagacgggatggtggacgcacacgctcacccgtctgggctggaagcgggacgattggccggtgcctcacgacctgcgtcacaccgccgcctcgttggccgtgcatgcgggcgcgaacgtcaaggccctgcagaggatgctgggccacaagaacgcgagcatgacgttggatgtgtacgcggatctgttcgacagcgatttgatggatgttgcccgtatgctcgatgccgccgtgcaggtggagacgggcgtggaagaatgtgggcaaaatgtgggcaaaaacgttttgaagcccgtctgaaacccttaaaaacgttggaatcacgccattcctgcgaatggtggttcttcagcaagttgaaggacgcactgagctgagagcggatgcgttcttggctccccctctgaggggagccaagtctgttacttcagcagggagcggcacatggagcggtattcgttgacgtagccgccgccgaagaagacgcaatggccggcgatggggtagagctgccagagcgtgatgcgctcctgccatccggccttcaacggatgtacggactggtagccctcggtgatttcgctcagatagctcataccgaacaggcgcagcatagccagatcctcctcgcgatgaccgccatgtgccgccgggtcgatgagcacggcctcggactgcccggaatcggcggtccacatcacattgccgctccacagatcaccgtggatgcgcgccggcttgtcggccgcggcgcggcccatcagatccggcagcgcttcaatcacacgctcagtcaactcgacatcgcgcttatccagctcgccacgtctcacaccaaagttgaccatcgggcgcagacgtccatcagcgaaatagctgatcgggtcggtccactcgccggtatccattttcaccgggtcctgcaatggtccgaaatagcatgtgccgttatatccgtcaggcgcagacccgaaatacttggcacccgcatcatgcatacgggccagagccgcgccaaaagctcgtgccgcctgaggcgtgggggacgcgctacccacacgttcgatatccagataatccttgccccagccgtataccttcaccacgcgcgggccgccttgcgcatgagccgcccccaaccattcgagtcctcgaccctcgcattcgaagaatccttccggtgcgaatgccctgcttttgcgatacgtggccataatgctcccttcgtcgcttacgtactatatccactttcattgtagaagccgtggatgttaccgattcttagtgttgttctacacccccttgggtagggtgttcatcgtcataacacatcaaatacttagaaatcacgaggggttatgaattttttccaagcgatcattctcggcatcgttcaggcgctgaccgagtatctcccggtatcctccagcgcgcatatccgtattttcggcgatttgatgctgggctctgatcccggtgcggcgtttaccgccatcatccaaatcggcaccgaacttgcggtgattctgtatttccgtcacgacatcatcaatatccttactcactggttcagctgcctgttcggcaagaacggcaaggattggaaggcccgcatgggccgcggcgacaattacgccacactcggctggaacattatcgtcggctcgattccgattattatcctcggcttcactctgcagaacgtcatcgagacctcgttgcgcaacctgtggattacggtaaccgtgctgttggtattcggcattctgctgtggatggtggatgccaaggctcgccagaacaaaaccatgaatgatatgacgtatcgtgatgcgttcctcttcggtttgggccagtccatggcgctgattcctggtgtgtcccgctccggcggcaccatcaccgtcggtcgcgcactgggctacacgcgtgaggccgctgtacgtctgagcttcctgatggccatccccgcggtgttcggctcaggtttgctcgaagccatcaaggccgtgaagaactacaaaaccgatgcgatgttccccggctgggggccgaccctcgtagccatggtcatcagcttcgtactcggctacatcgtgatcatcggattcctgaagttcgtatcgaacttctcctataaggccttcgccatctaccgcatcggtttggctgtggtcgtcgccttgctgctgattgtgggcgtgctgccggccatcgatccctccgtggtggctgcggcataagacgggtcgataggcgactcaatattaatggtgctcccgccggcgggagccgtcagcgaagctgactgggggtggtcactggaatatgccagcagaaccaccctcagtctcgctacgcgagccagctcccgacattttgtgcgacgtgcacatggtgcactgctatgaacagcccacagggctgttcatccagcgggagcacaccatatatgggctaattgcccatctggcgcagaaacgcttctgcttctttgaccagttgttcggcctggggcgctcccaatgaagcctccgcctcggctttctgctgcaagtcgtagtcgtgctccaaatgctccacataatcatgaagctggtcattgcaacgaaccagtatcgatgcctgcgccttccactgctcggctttctgcttcaggtctgccgtatcgaaaatgaagccgatatacttgcccaacgcatccagcaatcgtatagtgccggcagagcattcgtcgctgcccaaatattgggggatggacacccacatcgaggaatgagcaaatccttgttgtgcggcagctacatccagaacagtaggaatgcccaccgggccgttatacgaccggtctccttcgcattgacagtctccgtcgctgacggcgatgggcaacggacgggtatgcgggcaatcggagaacatcgaacctaacgtaatgatccgattgacatccagctcatcggcaatggccagactctggctacagtattccttccaccgatagttcggttcgggggcgatctgcgcatagatatgcttgcctgcgtccaacgtgatgtcgtagaacgtggtctgcggccagataagattggtgcgtcccgaaacatggcacagcataggacgggcaacctgatagtcatagaaatcatcacatctaatatgacgaatctcgcgggactcatatcgcttgaccagatggcgcaccgcgttcgtcgccgcctgacaggcatcattccatccctcgaatgcggcgatcaatactgcgccggtgtccttcgctgcttcactcatacctctagagtaactggaattcattgcccgaagcgcacgctttagccataagcgagagtatgcaattacaggcgacacgccgcagctggacgaactacacgcatgtgagtatagtaaacactcgtgcttcggtagggagacctcgccaaggaaacacacgcggacatagcttagttggtaaagcgcaaccttgccaaggttgagaccgcgggttcaatcgaaggcagccagcccgaacacaagcgttgcgcttacaaattgaatccggggggcctcatgagccgagggtgtaagggataaggtgtaaagggtaagggtttaaaggcgtaagggtgtaaggggacactcactcctgccggtacagccgcgaatacaatccgccggcctgcagcagttcgtcatgcgtaccggattcgacgatctgcccatgatccatgacatggatgcggtcgaaatcccgaatcgatgcgagtctgtgcgccacgacgatgcacgcattgtcggagtcgagcaacgccgtcatgacatgtcgctcggtatcgttgtccagagcactggtgggttcgtccataagtaggaagtccggtcttccgacgaccggatccatcatcccctcgttgatgccggcaacctcgcacgccctgacgatgtcgtcatccgtcagccacggacggtgcagcgtgatattgtcgcgcaaggtttcgttgaacaccgtggattcctgatgcacatacgccagcctgtcggccttccatcggctgtccgcgtcgtaaatccggcatccgccgtcgttgatggtcaccgtgccacagacgggttcgatgagtccggcgagcagtttcagcagcgtgcttttgcccgagccagtggggccgacgatggcgatcttgtcgccttcaccggcgggaatcatctcgcaaatcttgcgcatataggtggcgaacgccatgatctggctgatgacgccgacgatgccggagaaggtttcgatgaaggcgcgttgcacgtcagcctgcgcgacggtcgcacgctcgaccagcgtcctgttgcgcagggaataaatgacggatacgacgagcaccgccgcgcacaccgtcagggtcagcatcgtcaatggcgctgaataggcgatcatcatgatcaggtagaccacgaggaacaccatcgacacgaccgtcgacggcagactgccggtcacgatctgttcgacgaccatgaccaggttcgcgcggtagatcaggtcaccactggaacggttcacgaagaacgggaactcccgatcgagcacgccggtcatgtatcggcgggacaggtatcgtccgaatcgcacctgcacgcgggtgagcatcatggtgttcaacgcgccgaccgccatcgccgtgaacgctgggcgcgcccttccacgcggccacaggaggcgtcgcaggcgcggcggcgggaggacgtcgcgtttcccgattcccggacgggttcccatctccgagcgtccgccggaggccggcgaccgcagcggtttcggccattgggaggccgaaggcgtgatcggtgtcggatgtgacctgcgcaccgaggtcgagaggaggagcgggttcctcatggccaggatcgtgcccggcaagaccgccggggaaagcgtcggggtgcggctggcgatgttctcgccgctgccggccggcgcgcgcgtcagcgtcacgcacgacaacggcgccgggttcgcccgccaccaatcgaaggcagccagcccgaacacaagcgttgcgcttacaaattgaatccgggaagttaatatcaaacgaatagttgatgtgacatcgatgctgcgcgatatatctgacgtcgcttctctcgccccgcccgactgcggccagtaacctccctcgtcagagggagagattactagccaacggtgttgccgtagatttgggcttggaggtctttacgggcggtttccatgcgggtgatctggccgaggagggttatcttctcttcgccgtcgggcagctgggccatgcggcgtttggccaaaccgatctggcgcatgaagcccatgtccaacaatcgggtgagcagttcggtggcatagcgctgctcctccggcgtggcagggcgtagctgcacggcggccgcaccaccgccgactcccccaggcacgttcgactgcggaggttgtgcgccattaccaccgtcgtcgccaggcagtggcaacggcatgacggccagctcgttgatcacctgattcagcatcggtccgccggccttagtgaggttgtgcatccacagcccctgcggggtgtcgtcggatggcagtccgccagctgccgcaatcgcttggaacaaagtgcggaacaccggagtcatgaaatggtcgatggtcagctgtccgaacatggtgcggtcgatggcgcgcggcacctgaatcagcacggccatgaactgctgttcggcgatgaatacggcgtcatcgatcttgaagtacgcctgctcggcggcatcacggcgctccaaagccttgcgcgtggccggattggcgtacgggttggtgccgggctccacacgcggctcgtcacgctcgaaccgacgcttgggcgcataggcgtcctcatcgcgcacgtgcatctgccggcgcgcgttcatcacctcgtggcgcattacctcaaggtccacgccgatacggcctgcggatttgcgcgcgtaagcatcccacagggagcgatcgcgaatctgcgccaccagcggggccacggctttcatcgcaccgacctggccgggcgtataggtcaggtcgaaccggctgatggcggcgtcaatcacgaagtcatacaacggtttggcacgggcgatcagcgagcgcactgcttcgttgcctcgctcgatgcgcaaatcgcacgggtcgagattgtcgttggccacggccacgaaggtttgggagaggaaggccgaatcgaggccgaaagcgtgcagcgcggctttctggccggcggcgtcaccgtcgaacgtgaacacgatgcgagagctcaacggctggtccttgaccttcaacggcccgaccaactggaccgcacccagcgaatcgtcggcgatcaggcggcgcacgatcttggcgtgctcggcgccgaatgcggtaccacacgtagcaatggcggtgtcgataccggccaagtgcatggccatcacgtccgtatacccttcgacgattaccacctgccgcttcttgacgatggcggatttggccaaatcgatgccgtagagcacctgggtcttgcggtagagctgggtatccggcgtattgatgtatttggcggcaatctggtcgtcctcatacagtttgcgcgcgccgaagccgagcgtacgtccggtcgaatcgcggatgggccacgtcacacggccgcggaaataatcgtagatgccacgctggccttgacgggccagaccggcgtcgaggatttccttttgtgtgaagcctttgttggccaagtgacgtacgagattatcccagccttggggcgcgtaaccgcagccgaagcgttcacagtcggcctgggagaagttgcggccgccgagcagcttgcgggcgggcaatgcttccttggtcaggatttgggacacgaagaagcgctgggcttcctcgcaggcttccagcagtcgggtgcgcttggagccggcgttttcgcggttcggcccgttgccgctgttctcgtagtgcagttcgatatggtacttgtcggcgagcagctccacggcttcacggaagtcgatgttctcggattgttcgacgtatttgaacacgtcgccgcccaaaccgcaaccgaagcagtgccacacgccgagcgaggggcgcacgttgaagctgccggttttctcgtcgtggaacgggcacaggcctacgaatgtgccggtgccggagggcttaagcgttacggtcgcagatacgatgtcatacaggtccgcggcggcgcgcaccttctcgacatcttccttcttaatcattccgaccataagtctctagagtaccgccttacctgagacacggtaaatttttaccgttgggtactggttctctggggcttggccactctcggtcggcttcgctgacagctcccctcagtcagctacgctggcagcccccctcacccgaggggagccaagggtggaacaatggctcccctctctgaggctgagccgttaagcagacagcccagtgggctgtctgtaggcgaaggtgagacgacagtcgaaccagaaagatgcaggcgtggcctgtccggagttgcggacgagctggctcgcgaagcgagactgagggggagttccaccaaggaacagcctcaacacaaaatggaatgcagggccagggcggagttgtcggtcaggctcgccacctggtctatggccacgcgcagccgttcgttgtcgttggtggattcgttccagtcggccataaactggctttccagcgcgtcggagggccgcggcgaatcggccatcagcacgtcgatcagatcctccacgatcttcagttcctcctggtggaacggctccctctcgcgcggcgccatgacgaagtacacggcaatgcctttcaatgccacaatctcgtaattcgtatcctcgggaatcacgatattggcggaataccgggtcagcggccccgaaccataggtgtcgcgcgtggccgtctccaccgaccagcagaatcgcccgatcaggtcggaggcgatgttcttcaactgcgccaacgcctgccgcgatccgttgaaatgagcggggaacatatgctcgcggcgcaggcgcatgaacgcggccagcagcttgtcggcatcccacttcgccccataccatgcgcgcgtctgctcgatgatgtggtccagcatcttcggatcggcgagcacaatcggatcgaacgcgccggtggcgatggaatcctcgacgtcatgcacggagtaggcgatatcatccgaaaggtccatgatctggcattccatgggcttggtagcctgaggcgcgccgatcttgagccatcggaataccggctcgtcatccgggtagacgcagaatttcttcgaccgctccccctttgggtgttggtcggcttcggccaaggtccacgggtatttgacggccgcgtccaaggccgcacgggtcaggttcacgccggccgaacgcccgtccgggtgaaagatcttgggttcgagccgggtcaggatacgcatggtctgtgcgttgccttcgaagccgccgatattgccggcgatgtcggcgagcgcacgctccccattgtgcccgaacggcgggtgaccaaggtcgtgggccagacaggcgcagtcgaccacgtccggatcacagccgagcaatgcgccgatttggcgaccgatctgggcgacttccagcgtatgcgtcagtcgagtgcgagcgaaatcgtcggtaccggcaatcagaatctggcttttcgcgcccaaacgccgcaaagcggacgaatgaatcagtcgcgcgcgaccgcgctcgaacgcggtgcgtgacttggatttgggcggctcgggtgcccatcgctcctcgtcgaaggcgctgtagccctcgtcgctcagcacctgttccccatccaaagtcgtttccatatgccaagcataggcacacatatcggccgcagtaatcccgacttcccgaatatgtgccactgacgtcaactcaacggcacatattcgggagattggggccgatttcccgaatatgtgacgctcagcacatatcagtggcacatattcgggaagaagggattacggggtgccaccgtatggcgttaatgcaccttatagcagcgtggcggggtcgagtttggcgaggtcggcggcgggcagcacttcggcggcatgctcgtaaaggcgcgggatgcggttgcgcaggcaggtgaagatctcgtagctgatggtgtcggcggcgcgggcccaatcgtcggcggtaggctcaacgtaatcctcgccgcggcccgggccgaacagttcgaccgtgtcgccctcgtgaacgccgagttcggcggcggatccgtgcaggtccacgatgaactggtccatgcacacgcggccgcacacgcggtagagcttcggaccttcagtggtcatgatgcgcaccgggccgcccggcttctccacgtgcttggcaccttccatatcgaaaccggaagcggagcggtggatgccatcggcgtagcccagcggcacaatagcggtcgaggtgttgtccggggtcaggtaggtgcggccataagagatgccatggccggcctccacatccttgaccgtgccgagctgcgcctgcaggcgcatggccggggtcagatgccagtcgcgcggggtgcccatcgcgggatcgggctcgtagccgtacaggccgatgccggggcgggtaagttcgaagtgaatctccgggcggtccaaagtggccgccgtgttggccaagtgacggatctccggcggaatgccggcctgttccatgcggcgcgtgaagtccttgaatatttcgatctggcggtcggtggaggacacgaattcgggcacatcgggcgaatcggccacggcgagatggctccactgacccacaatatgcaacacgccctctttggcgagcggcacgagtttggcgagcgcggcgtcgaatccggccggcgtgaaaccgttgcgaccgaagccggaatcgaccttgacgtgtacgcgggcgggcttgccgagcttgcgtgcggcggcggccacggcatcgatgccgggcagggagccgaccgatacgtcgatatcggcagcgatcagctcatcgaatggcacttcggtgccgttgtagacccaagtcagaatgcggcaacggtcggggccgatgccgagtttgcgcagcagcagtgcttcatgcgattgcgcggtgccgagccatgtcgcgccgccggcgagcgcggccagtgcggcgggcagcagtccgtggccgtatgcgtcggccttgaccacgcccatcaccgccgtgccggagttcgggccgccgaccacggagaccaggtgggccatgttatcgcgcatggttttgaggttcacgatggcctgtgcggggtattggcggcgggcggccgcatagttggccttgccctgctcggacgagaatgcgatttcgggtgctgcgttcatgctcataggcacctattgttgcgcaggaatgtgacgtgtggtcacaatcgtttgttttcgcccggcagtcgtacactaatgaccgatatgcggtttctcggaagccgcctttgattcccggcgttgaggcgtgccgggatcccggaaatccgtccggtctagccccatatcttaagtttcatgagagaagaacatggatctgtttcgtaagaaaagcgtggatcagcttgtcgccgaatccactcccctgaagcgcacgatgcgcaccttcgatctgacgatgctcggtatcggcgcgatcatcggcaccggtatcttcgtgctcaccggcaagggcgcgctcaccgccggcccggccctgtccgtatcgttcctgctggccgccgtctgctgcggtttcgccggcctgtgctacgccgagttcgccgccatggctccggtctccggctcggcctactcctatgcctatctggcgttcggcgagctcatcgccttcgtgatcggctgggatctgattctggagtatgctctgcaggcggccaccgtgtccgccggctggtcgggatacttcaacaagttgttggaaggcttcggactgcatctgccggtcgagctgaccgccgcctacggcaccaacccggacgtcaccacctacttcaacctgcccggtttcgtcatcgtgctgatcatcacgtgggtgctctcgatcggcatcaaccagaccaagcgcaccaacgacgtgatggtgctcatcaagctcgccatcatcgtgctgttcatcgtgtgcgccgtgtggtatgtcaagccgtccaactggcagccgttctccccgtacggcatctacactttccagcccggctccacccagccgtacggcattgtgccggccgcatccatcgtgttcttcagcttcatcggattcgacgccgtgtcctcttccgccgaggagaccatcaacccgaacaagacactgccgcgcggcatcctgctgtccctggccgtttccaccgtgctctacatcgtcatgaccatgatcatgaccggcgtggtgccctacaaggagttcgccaagtacatcgacgccccagtggccggcgtgattctggagaccggcatgaactggctcgcggtgatcgtgaacctaggcgccctcatcggcatgaccacggtgatgctcgtacagctgtacggccagtcccgtatctgctacgccatgagccgtgacggcctgttcccgaagttcttcggccacgtgcacgagaagtaccgcaccccgttcaagggcacctggttcttcggtctgctgaccgcgttcgccggcggcttcatcaacatcaacgtgctgttcgagctggtgaacatcggtacgctgtccgcgttcatcatcgtgtcggccggtattctatggatgcgcaagacccagccgaatgcaccccgcggcttccgcgcgccgggcgtgccggtcaccccgattctggccatcgtattctgcttcgtgctcatcgccggtctcaactgggagacctgggtgcgtttcgccatctggttcggtctgggcctgatcgtgtacttcggctacagccgcaagcgctccaagctcggccttgagcagaaggccggggctgacaccaaggtcactgcgactgaggactgaggtctatcggctgaccgatagtcgatggctgctttcgtgaaaaccgtacgctgagttactttcagcgtacggtttttgcgatatgcacgagtttgaacgggcggccgacggaccgtacgtgcgcgacgacgtggaccttacctgaccagctcgaacgccgaccaggccatcgccgacaaccatcccaagacgctgctgaccatggaccgcatcggaggcggtggcttcgccggcatcaagcaggtcagcatcctcgactggccgctggagaaatagcgggccttgccgcggatcattccgccgttggaacactcgaggatgccagaccggacagttgatcccgccggtgtgggcaccaccatggcctagggagattggccatcacccgcaattcctgtgacggtcgacgctatctcaaatacgattttactttgtcaagaaaataccgcacattcgtggaatagttcggatatgcaatggcaagctgctctgcattgcgggcatacaccagcacggcattgtcatactcggtttcgctgctgatatcatcaatcgcgccagacatcttgatatgctgctctacgtcatcgtatctacggagcgccttgtccagctcctccgccgaaaacgcctcgacatcaagatactggctctctctggagagcttcagcaagaacaactctgccgaaggttccggcatctctacgacgaacacgctatctattgcagcgctcagatcgtccaatattccttgcgtacagtcgaggtcacacaactgtctgattaaggactcatacgttccggcgaatcccggtaccaacggtgtgcactcctccaacgcgaacagactggatacaagtctgaagaaacgcaaccgcctctcatcatcgccactggcgactgcccgtacagccggactcttgtattctgtgccataaatttctcccgctgcctcaactgcggtagaccagcaatgctgtaaacgtgtcctaatctgcacctccacatggtatgaggcggaatcggatttgacgttacacagcaggtgccttgatcggtatccgctggactgtgggtgttcgatatagtccttatcggtggagccattcttcaacggcagttttccggcaagccatgtggccgcgcgctgtacttgttcgtttgattccacaatcaatcggcaaccgccgatatcgtccaattcgccaagtttgaaatgcgtatcgggccgttgaattttgcgcacgatggaaatcatgcgcttcatccgaaacgttgccacggaatgctgtatgccctgcgaacatgccaacacctgtgagaagcactgctcggtcggcttgacatgctgggcacgccactgttgggcaatcagcatcgcttgcgcataatcgtcagcatcatcatgctgcaatccggcactcagcattcggccggccatattggcccgattcctactgatgcgcgcaatgccgttgtctgaagccatgctctacaatataacccttagaaaggaggagcaccatggcaaccattatcgatgttgcggcctatattcttcgcgaatatggtccgatgaccacaatgaaactgcaaaaactggccttttactcgcaagcggagtcattgtctcattatggagctcctctttttgaggaggatttccaagcatggcgcggaggccccgtgtgcgttgccctctactcgcagcaccgcggaaagttcctcattcgggacggcgaactacgagcagatccgagtatgttgaagggtacggaacagcgtgttatcgatgccgcatgttccgcacttgcagcgcttactggcaatcagcttagtgcgcgcacccacagtgaaacaccttggattgaggctcgcaacggattgtcggcctctgccccatgcaataccgtaatcagtaaaagcagtatggcgagctactaccgccgcaaccctattacgacgaacggcatgaatcctcgattccaataggcattccgccgcttgtcgaacgagtgtatggaatcggcgggtctgatgcggtcgaaggcgtgagcgatctacctgacggtgtcatgttccggttccagtcggcctgacacggacgaattgacggccatgagggtcttatccgcatcctggccatctgcgagcaagaaccgcagcgacgccttcggcaatatgccctcgtggccccgcgtccggtgatttagccggatagctgcgtaaaacgtggcgctgatactatttgaaatatacaaaacgtgacaattacatcatcatgatttagaaaaacgtgacagatgacgtgttattattaagaaaaacgttacaagacatatgatggcataggggcgtagatgctgtatcgcaaggcatgggatcgactggtcgtttggaaggccaatggggcctcgtcgcatgcgctgatgctcaccggggccaggcagatcggcaagacgacgctggtcagggagttcgccgggcggtattacgggcatttcgccgaactgaacttcctgaccgatcccaacgcctcgacgatcttcgacggtccgttggacgcgaagaccatcatcgccaacttgaccgcatatctgcgcacgccgttggagcccggcgacacgctcgtgctgctcgacgagatccaggagtgcccgcgcgcccgcaccgccatcaaattcctcgtggaggacggccggttcgattacgtggagaccggatccctgctcggcgtgcgcgtgagggacgtgccgtcctatccggtgggcttcgaggagcaatatcgcatgttccccatggatttcgaggagttctgcctggcgaatggcgtccagcgatccaccatcgacttgctgcgcacgcacttccgaagccgtactcccgtcagcgtcgccgtgcacgagacgatgatgaggctgttccgcgcctacatcgtggtgggcgggatgcccgaagtggtccaacggtatgtggacacgcatgacatcgcgcagacctcgcagctgcaacgcgaccttctcgacctctaccggctcgacatcgccaaatacgcgcagcgatcggaccgaacgaagatccgcgcgatcttcgacgccatcccctcccagctcgatgaccgcaaccgcaggttcgtgctcgccgacctgagcaagaacgcccgccagaaccggtatgccagcagcttcctatggctcgcggacgcgggcgcggccctcccctgctataacgtgtcctcgccgaccgcgccccttgcggccaacgaaaagcacagcctgttcaagctgttcatgaacgacgtcggtctgctgtgcgcggcgtcgatgggcaacatccagttcgcactcctgcagggcgagctcgacgtcaacctcggatcaatcgcggagaacgtggtggcccaggagctgaccgcccacggatatgccgcgcactacttcgacgccaagaaatacggcgagatcgacttcgtcgtccagtcgggcacccgggtcacgccggtcgaggtgaagtccggcaacgactggacccgtcacaaggcgttggacaacgtgctcgccgtggacgaatggaacatcgaccaggcctgggtgctatgcaaaggcaacataagccaggatggggccatcacctatctgccgctgtacatgaccatgttcctcgaacccgagcagccacccgattcgatgccattcacagtggacctgagcgcactggatacaccggacgagcaatgaacgccaatggaggcccgacggctccaccgcagaaacgaacacatcagccgacagccacactcaccactcgtggcgctgataggcgattctggtggtgtcgaccggccggtcgagcagctggatcaggccgcaacgggcgaagccggagctttcgagcacgtgctgcatggccttgttattggggtgggtgtcggcgcgcacgttgccgtagtgcttcagggtccacctgatacagtcgcgggccgcgtggcgcaccagaccggatgcggcgatgcggtggatggtcacataggcgtcgttgtccagccaggcgccgtcgattttggcgtaggtcggatcctcgcccggacacagggcgaactgggccagaatgcgttcgtggccattgcaggtgtcgaccagcagcatcgtacgctggttggcgatgtcgtcctcaatcatcgattcacgcggaaattcgttgccccactgggtggggttgccgttggcggccatcaacgcgcgtgcgcgtgcgtagattttctgcatctgcggcagatcgcgcatggtggcgtggcggaaacggcggcctgtcgccttgtttgcagcgttcgactgagtcacttctcacctctccgacatgccgggttgccggcacggtgaccggcgactaactgacggccaacctaccatgccgtaggcacaagaaatcccgtccgcgttgcatgacggacactaataaacaatgactcccgtccgcaggagccggacagtccagccgagttgaggacagccaccctcagtcggcttcgcccccggctcccgccagcgggagccgaatcagaattgaatcgaatcagacgaatcagacgaccttgcgctcgaacgggtcggagctgatgccttcctcaaggatctgcttggcccattccttggcggtgaacaggctgtggtcgcgatagttgccgcagctcttctcggtggtggcgggcacgtcatcccacgtggccttgtacgcgatgaactccaacgattccttcagggccttggccacttcctcggtggggtgggtgccccaggtcagcaggtggaagccggtgcggcagccgaacggcgagcagtcgatgtagcccgggatacgttcgcgcagcagaacggcgatggtgtgttcgatggtgtgcaggccgccggtggggatggcctgcttgttcggttgggtcaggcgcagatcatagttggagatcacgtcgccgtgagggcccgtttcggtgtcgatgtaacgcacgtacggcgccttgaccttggtgtgatcaagctggaatgattcgacgacgggcttttcggccgtttcttctgccatgctgttgcctttctacttgccgagtgttcggtcatgaagcatcgaacagtcatcgtagtcgagccagcccaagaacgcccgcaaatactccgcagttcgctataggagattgttatgacgcactcccggcattgaacgaggcgatggcttgcatgaagcgctggccgtagaggtcgagcttgtgttgaccgacgccgttgaccgccagaaattgcgcgttggtaaccggcttgatgcgggccatgtcgcgcaaggtcttgtcggagaacacgatgtacggcggcttgccgatttcctgggcgatggtgcgtcgtagttcgcgtagcttctggaacagcgattcctcgtcatcgtccgggatatacgagcccagcgcatcgccgggaacattggcggaatcggcagtatcagccactcccccgctccgaccggaaccggccgccgccgacttgcgttccacccgtttgatctcatagtggaagtcgggagcggcggtttcggccgcccgcgcaccgaacatgacgattggcatacgcccttcggcgattgacaggtacccgtccgtggccatctggctcaacacgtcgcgcacgcgagcctcgttcacgtccttgagcatgccgaaggtgggcatccgctccgggttcagccatgccagatcctgtgcccgcgagccgcgtagaatcttgacgattttgccggaaccgacgcgctgccccacgtcatgcacgcaccggctgatcgcctgcgccacgcgggtcacgtcgatggtctcgaacgtgctttcgcagttcgagcaggcaccgcatttgccggactgcgaagagtccgccgcaatgtcttcacccgccgtggaaccagcattcggcgacaattcctgaccgaaataccgggtcatataccggtgcaggcagtcggtggtgcggcagtagccgaccataccgtccagcagccggcgcttggactggcgaacgatttcctgctcttcgggagtcaatcgttcgttctcataatcgttatccagcaaccgacgccgggtgacgatgtctgactcattccacagcagcgtgcatcggctgggctcgccgtcacggcccgcgcggccggcctcctgatagtaggcctcaatggattcgggcagattgtggtggatgacgtaacgcacgttggacttatcgatgcccatgccgaaagcgttggtggccacgaccaccggcaccttgtcggtgatgaagtcgcgctgggccgcctcacgcgcgtccggcgacatgccgccatggtaggcaacggccggatgccccatctggttcagcgtgtcggtgagcgcttcggtggtcttgcgggtggcgcagtagacgatgccggattcgtccggatggtcggccacataccgcgccacccatgcggccttgtatttggtttccagtttgaccacatcaaaatacaggttcggccggtcgaatccggtaacggtgacggccggattccgcaatcccagcagtcccacgatgtcccggcgcacccgttcggtggcggtggcggtgaacgcacccaccggtggacgctgcggcagcccggcgatgaaatcgccgatacctaagtacgacgagcggaagtcctgaccccactgggagacgcagtgggcttcgtccacggcgatcagcgagatcggcgtacgggcggcaaagtcgcggaatcgcccggtttccaagcgttccggggccacgtacagcagtttgatctgcccggcggcggcttgggcgaacaccatcgcctgctcgtcgggagtttgagtggtattgatgaacgcggccggcagaccgaggtcgttcagcgcatcgacctggtcgcgcatcagggaaatcaagggagatatgaccaaagtcatacccgggctgagcgcggcgggaatctggtagcacacggacttgcctgcgccggtgggcatcacgcccaagacatcgcgtccggcaagcaaagcctcgacaattccttgctgtccgggcctaaacgagtcatagccgaagtatcgtgtgagcgcctccagcgccgcctgatgtgctgtcataaacgaccagtgtaggccgaccgcggctggatttcagcgtataacggaatacctcgcaacgatgtacgtagcccttccgtattattatgcgtcaaggaacgttattcccggcatatcgcacgatatgccgctttgagagaactaagacggggcattttgatggccaacgatacattttccttctcctctcctgacgatcaggagacggcggtgctgcagcctgtggccaccgatgggctgttcgcagccgcggattcaggtaccgccacaccacagcaaagtgacaatggcaccaataaccatgccgataatacagcctatgtgggtgaacatgttatggcatctaccaccgctaaatcacatggcaaggccgcacggattgccatcataaccatatttgcagtgttgcttgccgcattaatagcctatttcttcgtcggacgttggtacttccaagacaaggctgcgcccggtgttcatttgggcaatgtctctgtcatgggccagacccgcgaagaacttgcgaatactgtgaagcagcggctgaataacaccacggtgacgttcaccgccgaaggcaacagcgtcaaagcctcgctgaaggaccttggcgtcaccgtcgacacggataaaaccgtggatgcgctgttgaacgcgaagaccggcgacgtggccaagctcaatattttcgatcagccgcatatcgctctgaccgccaccacggacaaagagactgccgaacaattcgtcaccgccggcctagtcgatgaggccgaccgagcgcagattgccaccgttgtctacaacaagagcaccaaacagttcgactacaccgcgggtcaggacggcaagggcccggataccaatgttgtcaatgctgcagtcaaggaggccgtcgcgaccccgggcgaaaatgcgacggtgccggtcaagctacagaccgcaaagaatccgattgatgacgcgagcgcacagcaaacacagtttgacgccaatgccaggcttggcctcaaactgaccgtagacaacggcgtgaacaagagcgtcaccatcccggccgataccattgcctcattcctcaagcccacggtgaataaggcggaaggcaccatgagtctggtagtcgaccgcgatgccatcaccaagtacgtcaccagtgacagcgtaaccaaagaactgactgttcccaaggtgacacgcgaggtctacatcacgccgaaagacgaaggcggcgtggaaattggtgccgataagacactcggcgtggatggtattgaagtgactggcgccggggacgcccccgaacgtctggctaccgccatcgagcagaaccagtccactgattccactgtggctgtgaaagacagcccgtatgatgtcaagcaggtcgaggtgcctcataacttcgatacggcaaatggcgataagtgggttcatgttgatctgacgaaccagactgccactgcatatcagggcaccacggtggtcaagaagttcaacatcgcttctggcaagcccaccgccgatggttccatgctgtccgataccggcacgttctacgtgtatctcaagtacgaatcgcagaccatggttggcgaaggctacaaccagccaggcacgccgtgggtttcctactataacggcggcgaggccctgcacggtgttcctgcatacatgtggggcgagcaccccatctatgtgcagcagggtatcccaggctcgcacggctgcatcaacatgcaggtggccgatgccaagtggatgtacgactttgccaccatcggcactcgtgtggtcgttgatggcaccacaccgacttccggtcagacgttgcgcccggctggtgcggatgccactggatggcagggcggcaacgccagctgattcaatatgtttaatcgataacggaaaatccccgacccttgtgggccggggattttttgtaggtaccaatcgatagcgagtccgccgataagcgtggtggcaccgtcaatacggtgccaccagtaccgtcagtacggtcagatacgatccaacgcctgcttgagatcggcgataaggtcgtcggcgttctcgataccgaccgaaatgcgcaccaggttggcgggcacctgcagggtggtgccggccacggaggcgtgggtcatggcggcgggcacctcgatgaggctttccacaccgccgagcgattcggccagtgtgaagatctgcgtgtggtccacgaagtgcttggccgcctcggcgccggccgcgagctgcacggagacgatgccgccgaagccgccgtgcatctggcgggcggcgatttcatgacccgggtgggactcgaggcccgggtaccagacgcgctcaatcacatcagagggctgggattcgagccattcggccaccttcagggcgttggcactgtggcgcttgacgcgcagatccagggtcttcaggccgcggatgtccagccaggagtcgaacggggagggcactgcgccggcggcgttctgcaggaaggcgaccttctcgcgggtctcctcatcgttgaccaccacggcaccgccgaccacgtcggagtggccgccgatgtacttggtggtggagtagaccaccacatcggcgccatcggccagcggatgctgaagggcgggcgaggcgaaggtgttgtcgacagcgaccttggtgccgtacttgtgggcgacttcggtggtgaccgcgatgtcggtgatgttgagcagcgggttggacggggtctcgatccacacatactggtagtgcttggaggccaatgcggtttccacggctttcagatcggtgatgtccaccacgtcgaggcccacaccccacggcacgaacaccttggagagcaggcggtaggtgccgccgtacacatcgttgccgagcaggatgttgtcgccgggcttgatggtggagcgcagcagcacgtcgatggcggccaagcccgaggagaagctcagcgcgtacttgccgccttccacggcggcgagctgctcgtcgaagctggtgcgagtggggttgatggagcgggagtagtcgtggcctcccctgaggcccaacacgccatcctgcttgaaagtggaggtggcgaagatcggcgtgacgaccgcaccggtggtcgggtcgggctcctggccggcgtggatggcgcgagtggcgatgtcggtgttggcgaacttggcgttgtattcagcggacatgatattgggttcctttcgggatcgttccgtattcgaaggtagaacaggtacggttggttagtgcggatgttggtattgattcttttgatagctagttatggagtccgtccccagctccctcatcagagggagctccgttaaggtactgctcggcgagggagggcttgctggtgcgctccacgacgtcgccgtagccgttggcacgcatccagtcgtcgttgaagatcttctccaagtagctgcggccggaatcaggggcgagcaccaccacaatctggttctcgtccaaatcattggcaagcgcgtacttgatggcgctggccacggccatgccggacgagccgccgaccagcagcgcctcctcgccggccagacggcgggtcatttcaaaggcttcggcgtcggacacgcgcacgatgtcgtcggtgatgttccggtcgaaagccttggggtagaagtcctcccctacgccctcgatatcgtactggtggacttcgtcgcgtgaggaagcggagtagatggagccttccgggtcggagccgatgaccttgaccgcgccgttggaggcttccttgaggtacttgccggtgccggagatggtgccgccggtgccgatgccggccacgaagtgcgtgaccttgtggtccgtggcctcccagatctcaggtccggtggtgtagtagtggctcagcgggccgttcggattgtcgtactggttcgggcggaagccgccgggaatcgtattggccagtcgttcggcgacctggtagtaggagcgcgggtcgtccgggccggcgtcggttggcgtgacaatgacttcggcaccgtaggcgcgcagcaccgcgcgcttggattcggagaccttgtccggcagggtgaaaatcgtgcggtagccgcgctgctgggcgaccagggccaggccgacgccggtgttgccggaggtgggttcgacgatcacgccgccgggcttcagttggccggacttttcggcggcgtcgatgatgcgttcggcgatgcggtccttggaggatccgccggggttgaagtattcgactttgacggcgatggtggctttgacgccggccgcctgcggaatgtggttgagcttgacaagcggggtgttgccgatgagttctgcgaggctgttgtggatggtcatgtgaagtccttcgttgctggggttgtggggttttgctgcgttgcgctcgtgaaccgacgttcccagacgaatggactgtggctttagtttgaaatcgagtattcccgctcactgtacggtgaagccggaaagtgaatcggtttttcatgttaaccacggctcgcgcgttacacggttacgctcgtgccatcgatttcatgaaaattcatgcgacagatttgccgcgattcgaatgctctatctcaagttatgcgtcactgaccgctcgcccaggggcgtcggttagcgacaacaacatgagataatctgcatgtctcacaccatagcacaacccgcgacaagcgcgtgtcgcccccgggttctaaatagaagtgcaacaccttgtctagggttggaagtgttcgaagttcgaacacttccaaccctagacaaggtgttgcacttctatttagaacccgggctcacacgtcatcgaccacgatatgggcacatgatttgattagaatggtgaaacgtgacgacaagcgaagcaactatgcaatccgggcagtcagccggatcgggcgagtccatggcagccaagcgcgccagatttgaacagctcgccatgcccgccgtcaatgcactgtaccggcaggcgatgaggctgaccaacgatcccgatgacgcgcaggatctggtccaggacaccttcgaacgcgggttcaaggccttcgactcattccagccgggctccaacttcgaggcgtggatgaccaccatcgagcgcaatgcctacttcaaccagtatgccaaggccaagcggcgcccgcagcgtgccaacgactccaccggtgaatacgacgactgggacatttacgatgccgccgaacatacgtcggacgggctcaagtccgctgaagaggaatatttggacgccttcgcgcccgaggaaatcatggccgcgctcgccaaactctcgccggaacgccggcaggtgttcatcgacgccgccatcgacggcaagtcctaccagcaggtggccgatgagcagggcgtgaaaatcggcacggtgatgagccgcctgaatcgcgcccgcacgcaactcaagcgtgagctcgcctcgtatgcgaaagagcgcgggtacgtgactggttcgtcggctggttcaccatccgcgaagttgggcgaaaacgttggtcgaatcgccgattccggccataatggaagtagtgaacaaactgttggtagcaatggcgacacgcaagccgcagtgagacatagtcatgcgactggcgcccgcacgccacaacagtcaagcaagctttcgggaaaggagatctgatgaacgatcagccggtagagcgtactcgccatatctccataacccgtacgggggccgatggcatggtcagccagaccgaagtgcatatcacggcggtgcatcatcgttcagtggataccggctcggcctctgcgtcggtccaggcggacgtgcatatcgttacggagggcgactgttttgacccccgtacctgctgcgacgagcgtgaacaggcgttgattgccgcgttgcgtgcctacttgcgcccggatgtggcacccgaatgtctgatagcccggctcaaggccacgcttgatcactgctgcggcgaagataagtaacgacatatacaacaaggcccgtctgatgtatcatcagacgggccttgagcgttccataagaaacgcgaagaatcaggcgttaggacgcttgccgtggttggcggccttcttacgacgattcttgcgcttacgtccgcgcatgcccatgatggactcctttgctgcagtaaaaaaataagccttcggaattatgccacatgagcacgacgtgatgcaacacgggtgtccatgtggcgatgagcgtcaggcttggctattcggtttttcagatttgttcggcgtggaaggtgaccacggtggtgtagtcatcgcccggctcgagcacaaccagatccttgccggtgcggaaggcgtcggcgtaggcggtcatcggttcgacggccacgccggcctgacgagccttctcgccgatttcgttgccggtgcacacctgccaggagttgatggtcttgtcgccagtcagcgtgaccttgatgccgtcggggcgggtgaacacggcggaagtgctgccgtcttcaccgcggttggtgatatcggtccaggcatcgtcgaagccacgtccctccagcgtggggttatcgcgcaggtcgaagatgccggaaaccggctcttcaccggtgggcagcaagtgctcgtctacggtcacgtgggtgtcgcagtgcagctcaagacggcagggctcgttgtcggcggtaatggcctgaccggtggcgtgcttgccgttggccagccacgggtggatgccaaatgcccacggtgccttcacgctgtcgttgttgtgcacggtgaaggtttccgtgagaccgttctcgtcaagtgcataagtggcggtgatggtgatatcaaacgggtagccggcgatgtcgggggagcgccaggagagcgtcacgtgtgattcctgcaaatcaacgagctcccacatgtagcggtaggcatagccgtgcagggaggattggcggtcgaactcgtcgatcggcatctggtagtcttcgccatcgaaagaatactgaccattggtcactcggttcgggtacggtgccagcacccagccgttgcagcagggaatgaccttgttcgggtcgaaggggacgatgaggtcttcgccgcgccacttcagctcgcgcaggctggcacccagttcggtgacgacggcactccattcgccggacgagatgacatattggttaccagtgcgaggcttcaaagccatagtgcacactcctttgtggaacaaattgttatcgctcacaatcgtatcgcataagtcccaagacgcggcggcacataaggataaaaaattggctcccctctggaggggagccagcgtaacagaactacttctggactacttcgtagcggaccacagtggtgtagtcgccgttgggggcgagcgtcaccaagtggtcaccagtgcggaaggcattggccggggcggtcatcggctcgacggcgatgccatacggatgctcggcgaacggtgcgccagtggcggtgtagcactgccaagcattaatcgtctcatcgccaatgattttcacttcgataccgtccgggcgggtgaatgtggtggtggtcgtaccatcggcggcacgctccacgtcaacccaggcatcatcaaaggcgcggccttcgagcgtcgggccatcgttcaggtcgtagataccggtaaccggttcggtgccggtgggaatcagcgcctcgttcaccgtcacatgactggcggccttaatctgcaggtggcaggcggcggagtcggcatcgcgttcggcggcagttgcgccctgcttgccgttggccagccacggatgcaggccgagagcccacggtgccggttcgtcgccatcattgcgggcattgacggtcgcggtcatgccgttgtcgccgagttcgtaggtgacggtcacggtcacatcgaacgggtatccgtccaagttggggaagcgcagcgaaagcgtcacggcgctatcggtcaacgattcaagcttccacatgtagtggtaggcgtatccgtggttcgcattgttgcgcggtgcgggatgatattcgttaaccggcgcgcagtaatgcttgccattgaaatcgtattcgccgttttcgatgcggtttggccacggggccagcacataaccgttacaggtgggggtcaggtcgttgacgccgaacgggcagaaaatttccttgccttgataatcgaatcggcgaatcttggcgccgagttcgcagatgacggcggaataatcgccatagtgaatcgaatactgatttccggtgcgtggtgttttactcgtcatggaatcactcccgtagtgaggttggtgggccggtagctcctgctatcgctggccccagtctagcgcgtctcctctatcgaggcggggattggcgatatgcggcatataataaacaattcgtataaacacggtagcaatacgtggagtgacgagtctcacaccatcatgcgagaagcacgtggattccttggaaaccggtgatttgtgggagacgcggaaaagttgtgacggcagattcctgtaatccctgccttacactggaaaacactattgacgttcaggaggttccgatgaccaaaagcgttgtgctcgctgatccgcgaggcttctgcgcgggtgtggaccgtgcgattcttaccgtacagaccattctcaaagccgcggaggcttccggaaagcggacgcgcgaggatgggctgcccccggtatatgtgcgccggcagatcgtgcacaacaagcatgtggtcgaggacttggccgggcaaggcgcggtgttcgtccaggaattggcggagattccggatgctgctgcccaagcgggtattccggtggtgttttccgcccatggcgtatctccggtagtgaaggcggaagccgaacgtcgtggcatgcatgtggtggatgccacctgccctctggtgggtaaggtgcaccgtgaggtgctgcgtttcgtgcgcgaggggtatgaaatcgtctatatcgggcataaaggtcacgatgaagcggtcggtgtagtgggggagagccccgaacacgtgcacttgatcgagcatgaatcggatgtcgattcgctggattttgcgcccgacaccaagctggtgctgctctcgcagaccacgttgagcgtggacgagaccgccgataccattgccgcgctgaaggccaaattcccttggattcaagagccgccgagttcggatatctgctatgccacgtcgaatcgtcaggctgcggtcaaactggtggcccagcagtccgattgcgtggtgattgtcggatcggccaactcctcgaattccgtgcgactgatggaggtggcgcaggagggcttgggggagcgcggcaaagcgtatcgcgtggatgatgccagcgagcttgacccggcatggttcgagggtctggaatccgtaggtatctcctcgggtgcctccgtaccggacgaactggtgtccggtgtgattgacgctctgcaaaacttgggcttcaccggtatgaagtccgtcgaaaccatcaaagaaaacatgcactttgtgctgccggcggagttgcgcaggaagaagtagtcattcttggctcccctccgtgaggggagccaagaacggtcaccacgtgccgattggtgcggcaacggcgttcaagaccttgagcaggtcctgtggattcacgcccacagacaggcctcgcttgccgccggagaccagaatttggtcgaattgcagggcgctttcatccaacacagtcttatgacgtgtcttctggcctaacggcgagatgccgccaaccacataaccggattcacgcatcgccaccttgggatcggccatagaggccttcttggcacctacggctgcagccaaggctttcaaatccatatgaccgctcaccggtaccacgcccaccacgcgttcggcaccggtgtccgccatcaacgtcttgaacacctgatgctcgtcgaagccgagcttggtggccgcctccacgccgtagccgtcatccatatggtcgttggagtgctcgtattcgtatacgtggaattccacgcccgccttctccagttggactgtcgccggagtggaacccgcgcccttatcatgcttgcttttctttgccatgattaccgttctactacgaagaaacccccgcacaaggcgggggtctcacagcttagttctcaaacgaaccgtagcggcctagaccgcaatggttcactcggagatctcagcgaagtacagcagggtacggatcatgttggaggtgaagccgtactcgttgtcgtagaaggacacggtgcgagccagggtcacgccatcaatggtgttgacgtcggtctgggtcgggtcgaacacgccaccgtgggtgtcgccgaggatgtcggaggagacgatgccctcatcgttgtagccgtagtaatcggtgtcggagaaggcagccttgaaggcggcgttgatctcgtcggcggtggtctcggtattcagaacggtggtcagctcggtgacggagccgtccggaacctggacgcgctgggcgtggccctgcagcttgccgttcacggacggaacgaccttgccgatggccttggcagcgccggtggagtgggcgatggtgttgatggcggcggcgcgcaggttgcggccggtcttggtgccacgcgggccatcgagcagcatctgggtgccggtgtaggcgtggatggtggtcatgaagccggccttgatgccgaacttctcgtccagcagcttgaccatggcggccatggagttggtggtgcaggaaccggcggagacgatcacgtcggaagccttgaggatgtcgtggttcacgccgaacacaacggtcggggtggtgtcatccttggccggggcggagatcaggaccttcttggcgccagcgttgatgtgagcctgggacttctcggcggaggtgtagaagccggtgcactcgagcacgtactcaacaccgtcgttcttgacccacggaatgttgttggcgtccttctcggcgtagaccttgtattccttgccgtcgacgatgatggagtcttcggtggccttgacgtcaaccggagtgccatcgtcatgacggaaggtgccgtgggtgctgtcgtacttcagcaggtaagccagggtagccggggtggtcagatcgttgatggcggcaacttcaatgtcaccagcctggccgccgcgagcctgcagctcgaagatgcgacggaaggcgagacgaccaatgcgaccgaagccgttgataccaatcttaactgtcatgtaattctcccttgtagggtggccttggcgcgctttggcacaccgggccattgtttaccaacagttgctactgtaatgccgactctgtacacatggcaacgtttcagcgtgcgttttgggcaaaaatgccgtattttctgtgagcgctcacaattcggattgcccgcaaccgacatgtgatttttcctctcctttggaggaatgtctcgaatcatcatgagcaagcgcgcggcatgcaagtcagcgaaccagcagcttggacactgcggtgtccagctcgccgatatcgccgccaaattcgtggaatcgactcacctgaggcaacgccacctcgatggggaaggtgacgatcagtgtgccgtgctccacgctgatggccgcgtccacgccgtcgcggaactcgttgcttaccccctgcaccaccgtattggtcagcgtgccgtctttaagctcatatttcagccccggctcgttcacgccaagcgaaacatcggagtgggagaacgcagacaccatgcggccgtcctcgggcaccggatgcgcggggaacgaaagcctaccatcggtgatggccgtgacgatgagcccatcaccatacagatacccgcttgccccatgccgggccaataatgccatcagttgaatgccggaaatcgtatggtcaatgcggccgcccaaaccgccatagacatggaattcgcggcaacccgccgaccaaccgaccttcagcgcggagagcatgtccggatcgtccttcagcgcgggcagcgcgatggtgcgcacatcggtgcggggcggccggccctccagcgaatcgaagtcgcccaccaccacatcgggcacgatacccaactggcgcgtatggtcgagcccgccatcggccgcaatcacatacgcgccggccggcaccacgggcgtgcccgcatagtattcgcccgcaccaaaaatcacgcatacctgagtcatgatgcctactgtagccggtatccacccatcggccgggaaaatgctgataggctacgcatcagaacagtagtcgataggcgcacaggcaggggagcggagcgatggcacagatcaccgaggcaagcgaacggccgattctcaaatcaaagatattcctctacatcaccgaattcttctccggcatgtccgctgatctacttcatctcgatcaaggccaagcgcatcgcctgcgtggtcagcgccgtgatcttcgtggccacgtcctgcgtctcgcccctgaccggcttcgcgttctgggaaaccaacctggcctatgagggcgagtccatctacaactacctgcaggtcaagaacctctccgaccgcacgatcctgtccaccaacgtgctgttcggcgtgcagtccgtcacgatgaaagacaaaggactgacaggtatgtactacgacacggccctggctgcgccggcgctcgccgacaatgccaattccgcgctgatcctcggcatgggcaccggcacctacgcccgccagctgaagcagtattatccgaaaatgaacatcaccggcgtggagattgaccagaagatcaccgatctggccggcgaatacttcgatgagcccgccgacatccccgtgaccacgtatgacggccgagcctggctcgccgcctcgcatgacaagtacgacgtgatcatggtcgatgcgtatcaggacatcaccattcccttccagatgagctccaccgagttcttcaccatggtcagagagcacctgaaccccggcggcgtgatggtggtgaacatgaacatgatctcggacggccaaggttcgatcaacgaggcgttgagcgataccatcgccagcgtgttcggcaatgggaacacactgacggccgacgtgccgaacaccacgaaccgtgaactgttcgccaagaagccgggttccggctccgaagagaactccatgcagcaggcctccaaggcgctcaacctgcgtgagaccacctacgagcgcaccggcagcgaagatctcgaatggtatatggaagaggtcgcctctcgattccggaaggtgaacgaaccggactcagcgtcgactattctcaccgacgacaaggcgccggtcgaagtactcggcatgcatgccatcgatcaaatcatcgccgatgaggccggcccatatcggcagattctcaaagacgaaggcttcggcggtctgctgcgcgccgtgcagtaggttcgacacacggaccgcgaatgtccgggcgtatggtagactttctatttggcttgagaaatcaagaaagcggggcaaccccacctggaagcctttcaaggcctcgggttcaaggcaaacagcctagcgattgcgatatacaacgcgtaatcaggaatgacgcaaagaactgatatgcgtctgcagaagctgagcgcatattggcgcgggctttggcttgccatgaacccaaagcattgaacaggactccagcaaaggccctcgccacggaattgaagtagaggattggagtcatcatcagcgacgaaccacgtattaacgacgagattcgcgtcccgcaggtacgcctgatcggcccgaagggcgagcaggtgggcgtcatcgcgacttccgtcgcgctgaacctggccaaggaggcaaacctcgatctcgtcgaggtggccccgaacgcgaagcctccggtcgccaagctcattgattacggcaagttcaagtacaacgagaagatcaaggctcgtgaagctcgccgcaaccagagcaccgcggaaatcaaggagattcgtttccgcctgaagattgacgaccacgatttcgacgtgaagaagggccatgtgacccgcttccttaacggaggcgacaaggtcaaggtcaccatcatgttgcgcggtcgtgagatctcccgcccgattggtggcgtggaactgctgcagcgtctggccgacgatgtcgaggaatacggcaccgtcgagtccaagccgaagcaggagggccgcaacatcatcatgacccttgcgccgaagggcaagaaggtgcacacccagtccgagcagcgtcgtcgtggcgccgagtcccgcgccgagcgtcaggctcgccaggcggctcgtctcgcggccaagcaggagtctcaggctcaggccgcggccgacgcgcagtccgcgatttctcagaagacttccgacaagaagcaaaccagcaaggagggcagcaatgccgaagatgaaaactaattccgccgcttccaagcgcgccaagatcaccggcaccggcaaggtgaagcatgtcggttccgccatgcgccacaacctcgagcacaagtccgctcgcaagcgccgtgaactgtccgccgacgatgtgctgcgcggcggccaggccaagaagctgcaccagcttctgcagaagtgagcatagggcttacccggaaataacaagactttagaaagctgaggaatagattatggcacgtgtcaagcgcgcagtgaacgcccacaagaagcgtcgcgttgttctcgagagggcttccggctaccgtggccagcgctcccgcctgtaccgcaaggccaaggaacagctgctgcactcctttaactacaacttccgtgaccgcaaggctcgcaagggcgacttccgcaagctgtggatccagcgcatcaatgctgccgtccgcgctgagggcatcacctacaaccgcttcatccagggcctgcgtctcgccggcatcgagctggatcgtcgcgctctggctgagatcgccgtctccgacccggacaccttcaagaccatcgtggacgccgccaaggccgccctgcctgaggacgtcaacgctccggttgaggcctgattgcttgaagtcgtgacttcacactagaaaccccgcttccgagcggggtctctttgtaccatgggcactatgaccaacggattcaccagactcaccgagcagttcctcgtccacatcggcgtggagcgagggctcgccacggccaccgtcaccgcctacgaatccgacatcgccaaatacattgattggctcgaaacccgcggcatccacgaaccggacgccataaccaaacaagacgtcgaagactacatcgccgcccttgaccaggcgggggagtccgcccgctccaaagcccgaagactggcctcgatccacgaattccaccgtttcgcgctcggtcagcacgcggtgacggcggatgtttcggccgcagtcaaggcgcccaaaggcgccagcaccctgcccgacgtactcaccgtggacgaggtaacccgtctgctcgacgcggcggcagtcggcggctcaaccgatccggtggtattacgggacaaggccctgctcgaattcatgtacgccaccggctgccgcgtctcggaagccaccggtgcgaatctggacgacatcgacctggacgagcacatcgcgcgactcatgggcaagggctccaagcagcggcttgtgccattgggcagttacgcatgccgggccatcaccgcatacctcaatgcggggcgtggcgagttggaacagcgctccagcgccaagattcccgagaggcgcgcactgtttctcaacaaacgcggcaagcgcatctcgcggcaatcggtatgggaaatcgtcaaagcaaccggggagcgggccggcatcaccaaaccactccatccgcacaccttgcgccattcctttgccacgcacctgatccaaggcggcgcggacgtgcgcaccgtgcaggaactgctcgggcacgccagcgtgaccaccacgcagatctacacgcacgtaagccctgaaaccctgatcgaaacgtatctgacctcacatcccagagcgcggtgagacacaccattttgcgacgcgtccgcccatagcggaatcgcggcgggggagcaccaaagtcggccggaaattcaaggcgtgacaatacagtacataacagcgaaccgtcagccaggaagaggtattcatgctgcagatcaaatcgatctcgaagcgctataaaaccggtgatttcgttcagcaggcgcttgacaaagtcagcctgaacctacgcgacagcgaattcgtcgcgattctgggtccctcgggttccggcaagaccaccttgctcaacatcatcggcggcctcgaccggtatgacgacggcgatttggtgatcaacggcatctcgacgcgccaatacaaggatcgcgattgggattcgtaccgcaaccacaccatcggcttcgtgttccagagctacaatctgatccctcaccagacgattctgtcgaatgtcgaactcgcgctgacgatttccggcatcggcaaggccgaccgtcgcgaacgtgcgcgcaaggcgctggagaaggtcggactcggcgaacacatcaacaagaagccaaaccagctgtccggcggccagatgcagcgcgtggcgatcgcccgcgcactggtcaacgacccggacatcgtcctggccgacgagccgaccggcgcgctcgattcggacacgtccgtgcagatcatgaacctgctcaaggacgtggccaaggaccgcctcgtggtcatggtcacccacaaccccgaacttgcggaacaatatgccacgcgcatcgtcaacctgcgcgacggcgtgatccgctccgactccgacccgttcgtcgtggacgagacggccgaacagccggccgtgtacaagacgatgggccgcgcgtcgatgtcgttcgccacgtcgctggcgttgagcttcaacaatctgaagaccaagaaggcgcgcaccctgctgacctcgttcgccggctcgatcggcatcatcggcatcgcgctgattctatcggtgtcgactggcgtgaacacatacatcagtgacatccagcgtgacacgatgaccgcctacccgatcaccgtcgactcccagaccttcgacctgagcagcatgatgggcggacagatgggcggcgatgacggatacggcggcaagacgcacaaaaccgacggcatctacccggacgaccgcagcgtcaagcaggcgtccagcctgaccagttcgattaccgaaaacaacctgacccgcttcaagaaatacctggataattccaagagcgagattcaccagtatgtgggttccaccggcatccagtacacatatgacgtgaaattctccgtgttcgacgacgaccccgacggcacgctggtcaatgcggacggcgtgacgatcggatccagcgactctgcctcgatggcctcgcagatggcgtccacaagctcgtccggcatgtccggcacctcgtcgatcacctcgcagcagatgtcgatgctgaccggcaaaaccgatgagaacgccgcgcccgactcgttcaacgagatcatgccgggagcggacgacagcaagctcgtaggcaaggttatcaccgacaactaccaggtggtcaacggttcatggccgaagtccaaggatgaagtggtgctggtgcttgacgacaacaacagcgtgccgctgaccacgttgtacgagctcggcctgctgcccgcctccgattaccacgagatgatgtccaagctcaacgccggcgacaaggtcagcactccacaagacaagatcgactatgctaaggccctcgatcagacgctgtacatgattccggcatccgaccagtacgtcaagggcgatgacggccactaccgtttcatcggcaacgacaaggacgaaatcgaacagcgcctcgaaacggccaccaaactcaaggtggtgggcgtcgtcaaggcgaagaaggatgcttcggccacgccgttggccgctggtgtggggtacgcgcgcgctctgaccaatgatttgatcgaccgtgcggcctccagcgccatcgttaccgatcagaaggccaacccgaacacgaacgtgctcaacggcatgacgttctcgccctcggacgatgccaccaaggtgtccgacgcgcgcacctacgtggcttcgctgggcgtgacgcagaaggcgaacatggccaagtcgatgatgagcgccgggcagcagtccggcacgggcgcatcggacgccgctggtgctggtgctgcaggtgtcgctggcgcggcgggtgccggcgatcaggccgccgccatggccgcgatgagcgaacagcagctcgccgacagtttcgacgcgtatatcgccacggcttcgaacgacgtgcttgtcgcgatctacgaccagtacgtgtcgaccggcacctacgacgacaacctcgccgcattcggtgtggtgagtcgtgacgcgcccagctcgatcaacatctacgccgacagcttcgaagacaaggaccacatcgccgacgcgatcaccgactacaacaacaccgtctcgaagaaagacaagatcacctacacggattacgttgggctcatgatgagttcggtgaccaccatcgtcaacgtgatttcctacgtgcttatcgcgttcgtgtccgtctcgctgatcgtctcctcgatcatgatcggcatcatcacctacatttcggtgctggagcgcaccaaggaaatcggcatcctacgcgcaatgggtgcctcgaagcacaacgtatcccaggtgttcaatgcggagaccggcatcatcggcctatgctccggcctgttgggcgtgggcttgaccgtgctgctcaatattccgatcaacgccgtgctacgccacttcatcggcaatgcggacgtcaatgccgccctgccggtgaccggtggcgtggtgctggtgatcctaagcgtggtgctcacgctgatcggcggcctgattccctcgcgtaaggcagccaagcaagacccggccaccgcactgcgcaccgagtaagcgcatcgacatagtacgagacgagatccataaacctcggaacactggaataccagcggcaaaacggtgttccgaggcgagcccggcgagtacattaggatgggcgagcaggtattcccgacaaagggggcgagggcaacgatggacgactggcgagatacccgcgataaagacagcgcattccgtcaaggaacgctgcctatgacaggaacgtatgtcgttgcacccccagcgaacccggatgttgataaggtagacagtatgcctaccgatttgcttggacgtgaatacgaaaccttccccgcacccgaaccgctgcaacagcacggtccggcgcgtgtcattgccatgtgcaaccagaagggtggcgtaggtaagaccaccagctccatcaatattgccggtgcgttggcccagtatggccgccgcgtgcttatcgtcgatttcgatccgcagggtgccgccactgtgggactgggcgtcaacgcgaataccgtggagaacacgatttacaccgcgctgttcgatatttccgtggacccacatgatgtggtgcagcacaccgcattcgagaacatcgatgtgattccggcgaacatcgatttgtccgccgccgaggtccagctggtcaccgaagtgggccgagagcagatcctgaacagcgtgctgcgcaagctcaagtcggaatacgatctcatcatcgtcgactgtcagccatcgctcggcctgctcaccgtgaacgcgcttgccgcagctgatggcgtgatcattcccgtggccgccgaattcttcgccttgcgcggtgtggccctgcttatgcagtccatcgaaaaagtgcagtcccgcatcaatcccgcattggaagtggatggcgtgctcatcaccatgtacaccaagacactgcactgcgaagaggtctgccagcgcgtttacgaggcgttcagcgaaaaggtgttccacacgttcatctcccgctccatcaaactgcccgattccacggttgccgccgcgcccgtggtggtctatgcccctgagcacaagacatcaaaggaataccgtgaggtggcacgtgagctcattgctcgcggcatcgtggcgtaacgattgtttcgataaacgatgaatgagacttccctttctcggctcccctctctgagggaagctggctcgcgtagcgaggctgaggggagctccgcggaagccgaaatcagcacggaggaatccgccacttccggcttccgggtcaacctcgaagtctattccggtccgtttgatgccttgctcggcatgatcgccaacaacagactcgagctgaccgaagtttccctctcctcgatcaccgaggaattcctgacatacgtgcgcgggctcgatttcacaaaaaacatggatgaggccagcgcctttctcgatatcgcctctattctggtcgaggccaaaagcgtggcgattctgcccggcggcgaagacagccagcacgacgagcagagcctcgaagtgctgcgcgaacgcgatttgctgttcgcccgactcctccaataccgcgcctacaagcaggccgcaggtgacttccgggcgcgtatcgccgccaactccggccgattcccgcacccggcggccatggacgagggcgttgccgccatgctgcctgagctggtatggacgctgactccgctcgaactcgcccgactgaccgcccaggtcatcgccaacgcgcccgcctccgaagtgtcgatccatcagctgcacgtgccgttggtcgatctgcgggcccaatcgctggtggtgcgcgaccggctgatcgcggcattggaatccaagggcgaccagtcgatatcgttcagcgaattgacccgggactgcacttctcgtattgaggtggtggctcggttcatggccgtgctcgtgttcttcaaacaaggtgtgctgcagtatcagcaagatggtccgtttgccgaactgcacctgaggtgggtacccggcgtagccgaaacgatgagcgacgtgaacatttccgaaggtgattttgcgtaaggacggcgattggtgactgaacagattgacgcaacgaatacaaccgaacacatggcggatgccgaatcgacggctgaatccgcaaaggccgcggtgaggggagtggaggagacgcaccccgaatacgtggatttcgcggtagacgattttcccggcgggctgcccgcctgtctggaagcgattctgatggtcgccgaccagccgcagaccgccaccgagctggcccgtattttggcattggatcgcaacacagtcgaagaggcattgcgagccctgcacgatgactatgagggcgatgaatcccgtgacatccgcccgcgcggcttcgaactgcgccgcaccgctcgtggctggcagttcgccagtcgcgccgcgttcgagccggtcgtctcatcattcgtcaccgacggccagactgcgagactcagtcaggccgcactggaggcgcttgccatcgtggcctatcgccaacccgtcacccgagcccaagtggccgcgatccgcggtgtcaactccgatggagtgattcgctcgctcacggtacgcggccttatcaaggaagacggcgtggaccccgaatcccgcgcggccctcttggtcacctccgaattcttcctcgaccaaatgggtctgaagagtctcgacgaactaccctccctagcgccattcctcccgtccgtcgccgaaatgacacagtcgaaatcggaagatacggacgtgatttcgtagcgattggggcccgctgcctgaccaatattcgtgcgctagaccatccgatatgtgatttatggtcattgtgactataagtagtgctatgctctcaatgcagggagaacaaccggtatggaaagaggcatggcatgggattcggcaatgtgtccgagcgccgcagcgcaccgccacaggtcggcgtgtcagtggtgattctggcactcggcccggaaggcgataccggcaacagtgccgccgattccggcaacgccgcgaactcggcccattcccgtctctggttgcccctggtcaagcgcgtccgtcagccgttcctgggctgctgggcgttgcccggcggtgacctgcgctccgaccggtcgttggaacagtctgcctacgcggccctcgaatcgaccacagacctgcacccgcgatacctcgaacagctgtacacctttggaggcccgacccggtcccatggcggattgcccatggtatccgtcgtgtactgggcgctcgtcggccagaccgaggccgcgggcttcgaggacggtgacaacgtacgatggttccccgaagacgaactgcccgagctggcgttcgaccatcgccagatcatcgactacgcgctgctccgcctgcgctccaaaatcgaatactccgacgtggccacccgactgctcggccccacgttcaccctgcgccaactgcacggcgtctatgaggcgattggcggcgaacccctcgacttggcgaacttccgccgcaaaatgcttgcctcgggagatcttgaagacaccggggagaagatgcgcgaaggccgccaacgaccggccaccgtctaccgctacatccccaaacgacctgtcgagaacggtacgccccacgaatccgatggtgacgacatcgtggaactgtccagacaaggcgagcgtgaagacgctctcgacgcgctgatcccatccgcgcgcatctgatttttcccgccgacccgcttcgggccggtatcacagacgtatataggaaaggaaccactatgaccgcactattcactgcgccgtccgttgacgagatcatcgccaagctgggcgcgcaaagcacctgcgatgcaggactgacccaggacccatggcacttcgacaccaccacacccagctacggtcccggtgcctcgatgctcgaccgtctgcccgccaacgcgccgcgccagcaggtgttgccggacgaataccgcaaggcctccgacgaggaactgcagcagcgcatctccgacgccaagcagcgtctcggctccaaactgttgattctgggccacttctaccagcgtgacgagatcatcaagcacgccgatttcgtgggcgactccttccagctggccaagaacgccaccgaacgcccggacgccgaccacatcgtgttctgcggcgtgcacttcatggccgaaaccgccgacatcctctccacgcccgaacagagcgtgaccctgcccaacctgtccgccggctgctcgatggccgatatggccaacatcgaccaggtccaggaatgctgggaccagctcggcgagatctgcggcacccagccggactccgatggcttgcagcagatcattccggtcacctacatgaactcatccgccgcgctgaaggcgttctgcggacgcaacggcggcatcgtatgcacctcttccaatgcgcacgccgtgctggaatgggcgttcgcccgcggcaagcgcgtgctgttcttcccggaccagcatctgggccgcaataccgcccgcgcgatgggcattccgctgagcgagatgccgctgtgggatccgttcaaggcacagggcggcgccgccgatccggccgattacgcccgcgccaagatgattctgtggaagggcttctgctccgtgcaccagcgtttcaccgtcgaacaggtcgaacgtgcccgcaaggcatacccgggcgtcaaggtgatcgtgcaccccgagtgctcgatgcaggtggtcgatgccgccgacggtactggctccaccgcgtacatcgtcaaggagatcgccaacgcgcccgccggatccgccattgctgtgggcaccgaaatcaacctggtgaaccgtctggccgcgcagtacccggacaagaccgtgttctgcttggaccccgtggtctgcccctgctccacgatgtaccgcatccacccggcctacctggcttgggctttggagaacctcgaagccggcaacgtggtcaatcgcatcaccgtggacgaagacaccgcccgcgaagccaaggtggcactggagcgcatgctgcgcgttcacccgtgattcgtccctggcgctcctcgtacatgaggggagctgtccgcgtagcggactgaagggagcagatgacgcaaaaacagaggaaagcaacacaatgagcaacactgaaatcgtcgtcgtgggcgccggcgtcgccggactgtccgcggcactggccgtggccggcaccggacacgacgtgaccttggtaaccaaggccgaactggtggaatcaaacacctatcatgcgcagggcggcatcgctgcagccatcttctccgacgacgacccgaagctgcatgccgccgacaccatggccgcgggccacggcctgtgcgacccgaaggccgtggacatcctcacccgtgagggtgcggagcgcgtccgcgagttcgccgcggccggcgtccacttcgaccgcgacgcgcatggacacatgctgcgcggcctggaagcggctcattcgcgcgcccgcgtggtgcatgccgggggagacgccaccggcaaagtgtttgaactggacgtctccgccatggtgcgcaagaacccgcgcatccacatcatcgagaacgccttcctcaaagatctcatcgtgcggggcggccacatcgccggcgtccacctgctgatcgacgggcaggacaaggatctggccgccgaccgggtgatcttggccgccggtggagcaggccgtatgtacccgtacaccaccaatccgccggtctccactgcggacggcctcgccgtcgcatggcgtgccggtgcccaggtcgccgatctggagttctaccagttccatcccaccgccatggccgtgggcgagcacttcctcgtctccgaagccgtgcgcggcgaaggtgcggtgctgctggatgagcatggccacaggtatatgaaggacatcgatccgcgcgccgaactcgcgccgcgtgacgtcgtggcccgcgagaacttccgcgtgatgcaggcgcaaggcggcaagcccgtgatgctcgacgtctcgccgatggcccgcgagaaccccgacctggccagcttcttggcccaccgattcccgaccatcgacgcctatacgcgttcgcttggcttcgactggagcaaggagccgattccggtggcgcccgccgcgcactactacatgggaggcattcgcaccgatctgaacgcccggacctccattcccggcctgtatgcggccggcgaatgcgctcgtaccggtgtcatgggctccaaccgtcttgcctccaactcgctgctcgaaggacttgtctacggacgccgcgccggtctggccgccgtcgcggacggtgacgacgcggtctgggcacccgaaccgttcctgaactccgccaccggtgccgtgttcgaccatgcgccgatcgcgctggccgcccctgccgctacggctgctgctgacgataccgccgccgacaaggtgtggaatcgtacccgcatccagaacaccatgtggcatggcgtcggcgtgctgcgcgacgaggccggactgaaaaccgccatcgccgaactcggccaaggcctcgccgccgcaaacgcccaggctgatgtaaacgccgatggtgctgcaagcagcgttgaggctttggagaaccgcaacatgctcaccgtaggctatgtggccgccaccgccgcgctcgcccgcaccgagtcgagaggcgcccacgcccgcaccgaccacagcgagccagtcgacaactgggcccactccgtcgcctacatcaaggactgacccatgctcacatcacacatcatccgcgtcgccgtcgaagcggcgctcgccgaagacgcgccctacggcgacatcacctgcgagaccaccatccccgcggacgaaaccggctcggcccacctcaccgcgcgcgaaaacggcgtgatgagcggcatcgacgtgttcgccgcagccttcgccgcacagaacccggccgtcaccgtcaccgccgccatcaaggacggcgagcgattccagcgcggccagatactcgccaccgtgaaaggcccggtacgcgacctgctcaccgccgagcgcatcgccctcaacttcactcagcgcatgagcggcatcgccaccatgaccgccgccttcgtggacgcggtgaacgccatctacggcgatgattatgacggacccgtcacccggccgcgccgctacgagcgcacccgcatcgtcgatacgcgcaaaaccacgcccggcctgcgcccgttcgagaaatacgccgtggtctgcggcggcggccacaaccatcgttacggactgtccgacgcggtcatgatgaaggacaaccatctggcggcgctcgccgcgcgcggcatcgacctggccggcgcgatccgccacgtgcgcgaacaggtgggccacaccacgcatatcgaagtggaagtcgaccgccttgaccagattcccgccgtgctcgccggcggagcggacaccatcatgctggacaatttctcgctcgacgacacccgtcgcggcgtggagctcatcgacggtaaggccatcgtggaagccagcggcaacatgagcctggagcgagtgccagccgtggccgtcaccggcgtggacgtgatctccgtgggcgcgctcacccactctgtgcgcagcatcgacctcggattggattggaactagtcatggccgatacccccaacgcatccggtgaacccggcgaactgtacctggacgccgccgccaccgaatcagtgagcccggcagtcatcgaggccatgaccccgttcctgactgaggcctacgccaatccggccagcgtgcaccagcccggcaaaaccgcggcccgcgcgctggacgcggctcgcgcatcatttgccgcggcattgggcgcccggccggatgacgtgatcttcacctcaggcggcaccgaatcggacaatctggccatcaaaggcatcgccatggcgcgcatgcgcaaactgggcttgcggccggtctgcggattcgccgaagccgatggcaaacagccggcaaattgtcgcccgcgcattatcatttccgctatcgagcacccggccgtggcccaatcggcggcatggctgcacgaatggttcggtttcgaagtcgtgcgcattcccgtggatgcgcaagcacatctcgatctcgacgcacttgaacgcgagctcgacggcgaggccagtgaacgtaccacgatggtctccaccatgctggccaacaacgaggtcggcaccgtggaacccgtggaggaactggtccgcatcgcccacgcgcacggcgtgcccatccatgtagacgccgtacaggccgccgggcagattccgattcgttttcgtgactgggatgtggacgccctgtccgtatccggacacaaattcggcacccccaaaggtctgggagcgctgctggtacgcggccgcacacccatcgaaccggtgctgtccggaggcgggcaggaacgcggcctgcgctctggcacgcagaacgtggccggtgccgtggcgctcgccatcggactcaacgaatcgaatgcgcgcatgcaggcgcagtaccgtgagttggtcgcgtcccgagacatgctcatcgacgcggttcgccgggtcgcgcctcgcgccgacctgaccggcgaccccgaacgccgtctgcccggtcacgcctccttcatcttccccggcgtcaccggggaagcgctgctcgtcgacctggacgcgcgcggcatcgctgcctcatccggctcggcctgcgccatcgggcgccacgagattcctgccacgttgctggcgatgggcctcgaaccgtccatcgccaaatcggcattacgcatgaccttccgcaagccgctgacccgcgaacaagtcgaacgcatcagcttggccatcgaagagtcctacaccgacctgacccgccattaaatctgacgccacttaccagaaaggaaacgacgtgagcaccaccacttcagcgcaacccgcgcagctcacccgcaacgagcgcctcgaccggctgcccttcaacaaggcgcaccgcaaactcctcgtcgcctccggcatcggctgggcattcgacgccatggacgtcggcctcgtctccttcgtagtcgccgccatcgccgccgacccgcacttcaacctcaccccgaccgaaaagtcatgggtgctgtccatcggcttcgtcggcatggccatcggcgcggcagtgggcggcttcatcgccgaccgcgtgggccgcaaaaccgtgttcaccgccacactgattatcttcggcatcgccaacggtgccatggccctatcttggtcactcggcatgctgctcggcgcccgactgatcatcggactgggcttgggcgcggaactgccggtcgcctccacgctggtctccgagttttcgccgaccaaacagcgcggccgcatgactgtgctgctggaatcgttctgggccgtcggctggatcgtcgccgccatgatcggctacttcgtgatcccgaacaccggcgactggggctggcgctgggcgctggccatcggcgcgctgccactgctctacgcaatcgtcacccgcgtgcacatcccagaatccgtgcgattcctcgaagccaagggtcgcgaagacgaagccgaaaaggccgtgcgctacttcgaggaagccgggggagtagccccggtaacctctcccaagggcaagccgctgccgaagatcaagacgcgcgaactgttcggctccaagtacctggcccgcaccatcgccatctgggccacgtggttcttcgtgaacttctcctactacggcgcgttcacatggatgccgtcgctgctcgccgaccagttcggctccctgaccaagtcattcggctacacgctcgccatctccatcgcccagctgcccggttacttcctagccgcctggctggtggaggtctggggccgccgcaagacgctgagcatcttcctggccgtctccgccgtggccgccttcgcgttctcgcaggccggatctgtggccctcgtgctcgtgttcggcatgctgctgtccgcctccaacctcggtgcgtggggcgtgctgtacgccgtgaccccggaaatctacccgacccgcctgcgtggcgcggccgccggtgccgccgcagcggtgggccgcatcgccgccatcatcgcgccgctcctcatgccgtggttcctgaccctgtccggcggcaacaaggccgtggccttcatcatcttcgccgccgccttcatcatcgcctgcgtcgccgccctctgcctgcccgaacgcaaaggcctcgatctcgaagactgacggaagtcgatgacgggagaacagatatttgcctgattaccggcagaacccccgcgtcccggcgaaagggacgcgggggttctgccgtttgaaggccgtaaaaacggcagaaatcccgcgaggggttcgtcgagacgcgggagttctgccgttgtgaggtgcttttctatgttccgacatagtcaaggtgtgcgagtaccatcgtgacggtttgtgtgtaggtatgaataaacacctcagagtaagtacttaagtactcgagaacgcaagtaccgaacgattacgcaaaagaatcagtattaagagaggtttcgatggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtaatggattccaacgatctggaacgcgagaagggcatcaccatcctcgccaagaacacggccgtggaatacaccggtccgctggccgccaagtacggccacccggagggcatcaccctcaacatcatcgacacccccggccacgccgatttcggcggcgaggtcgagcgcggcatctccatggttgacggcgtcgtgctgctcgtggacgcctccgaaggcccgctgccgcagacccgcttcgtgctgcgcaaggccctcgaagccaagctgccggtcatcctgtgcgtgaacaaggtcgaccgccccgacgcccgtatcgaagaggtcgtcggcgaaacctccgacctgctgctcggcctggccgacgacgtgcagcacgagggcatcgacctggaccttgaccagctgcttgaaatgccggtcatctactgcgccgccaaggccggctacgcctccgtgaaccagcccgccgacggtggcctgccggacaacgacaacctcgagccgctgttcgaaaccatcatctccaccatcccggcccccgaatacgaggagggcgccccgctgcaggctcacgtggccaacatcgactcctccgacttcctcggccgactcggtctggtccgtatctacaacggcacccttgagaagggcaagacctacggcctgtcccgtgtggacggctccctcgagaacttccgcgtctccgaactgctgcgcacccagggcctcgagcgtatcccggtcgaatccgcaggccccggcgacatcgtggccgttgccggcgttaacgacatcatgatcggcgagaccatcgtcgaccccaacgacccgaagccgctgccgctcatccatgtggacgatccggccatctccatgaccttcggcaccaacgactccccgctggccggcaccgagggcaaggaccacaagctcaccgcccgcatgatcaaggaccgtctggaccgcgagctcatcggtaacgtgtccatcaaggtgctgcccaccgaccgtcccgacgcttgggaagtccagggccgtggcgagctggcgctggccgtgcttgccgagcagatgcgccgcgaaggctacgagctgaccgtcggccgtccgcaggtggtcaccaagaagatcgatggcgtgatcaacgagccgatggaaaacaccaccatcgacgtgccggaagagtacatgggtaccgtcacccagctcatggccgaccgtaagggccgtatggatggcatgaccaaccacggctccggctgggtccgtctgcagttcaccgtgccgtcccgtggtctgatcggcttccgcaccgcgctgctttccgccactcgtggcaccggcatctcctcctccatctctgccggctacgcgccgtgggctggcgccatcaccattcgccagaacggttccatggtttccgatcgcaagggtatcgccaccccgtacgccatgcagcgtctgcaggcccgtggcaacttcttcgtcgaaccgcagtccccggtgtatgaaggccaggtcgtgggtgtgaacaacaagcccgacgagctggacgtgaacatcacgctggccaagcacatgaccaacatgcgttcctccaccgctgacgtgctcgaaaccctgaccccgccgatcaagatgagccttgaggagtccctggacttcgccaacgaggacgagtgcgtggaagtcaccccggagtccatccgcgtgcgcaagatcatcctcggccgtgaggactggtacaagtggcgcgccaagcagcgccgccagaacgccgcccagcagggtaagtgatttggtgcggctgtagccgaccattctctctagctcccctctctgaggggagctaagtttattcctcaccaagtcatatccccacctatactgaaacgcatgactgtgaagagcactactgaattgcgtccgtggtcgtatcgccagaacgcgctggtcaaatcgttgatcacgattgcggcgggcgtggcttccgcctttgtgggcacgttcgcccaccgtatgggtgcggaactgaatattccgtatggtctggtgctggcgtttctgctgatcggcctatcgacatggtgcgcccgttcgcgcatgggcgcggtcggactggccctgcacctcatcgcctcctcactgaccgcatggggcatggcgctgaccaccacatccggcaaagcgctcatcgtcgccggattccaaggcgacatgccgttcttctcccaacatgccggctacatctggctgtacggcctgatactggtccaagtcgtcctgctcattcttcccgcccgctggttcgtcattcccactcattctgaatcgcgcgcgtaactatatatggcgatacattcccgggaatgcgtcgcgtatcggcgggcgtaggggattacggccgctaccatagaactttatggcacgcatgaaactgttttacttgggcccggagggcaccttcacccatcaggcggcaatgacggccgccgaccagttcgccacactcggcgacttcgacctcatcgctctgcccgacgtgcccgcgatcatgcaggccgtacagtcgcgccaaggctggggcgtcatcgcatgggaaaacaacgtcgaaggctatgtggtcccgaatctcgacgcgctgatcgacgcccccaacgcggccggcttcgcccggatcagtgtggacgtggccttcaacgccttcaccgtgcgcggccacagcatctacgactgcaccggcaaccccgtcagcgcccacccgcacggtctggcccaatgcacccggttcatcgccgaacaccatttgcagcccgaacccgcatcctccaacgccgccgcctgccgcgacctgaagcccggccgcgtggcgctcggccccagcatctgcggcgaactctacgatctcgacaccctcgccgaacatgtgcaggatttcgatggcgcgcacaccgaattccttgtcatcgccccgcgtgatgtggtccaggaactcaacgcccgcgcccacagcaatgacgccggcgacttcgaaaccatcatcaccttcatcccgctggtcaccggccccggcgtactcgccgacctgctggacgtcctgcgcgatgcgggactgaacatgaccagcttcatctcgcgcccgatcaaaggccacgacggaacctacagcttcatcgccacccttgacgccgccccctgggagccgagattccgcaccgcactggaagagatcgccggacacggcgactgggcaaaaaccctggccgtctacccacgccgcgaacgcccgaacccgccggtcgacgcctggatgctgcccgagggcggcgtccacatcaccaatcgcgcgccggaaggctggcagtacaccgaggaagcaaggaaggaactgctgtggtagatacagtcggaatcgtcggactcggattgatcggcggctcgctcgcacgccgcctgaccgagcgcggcgtgcgcgtcgtcgcgtggaaccatcgcccgcacccctacgcccaggccgaagccgatggcattttctgcaagagcacgctctccgaactcatggatgccgagccggatgtggtcgtgctgtgcaatccgctcaaggcgatgcccgcaatcctcgccgccctggccccgctcatgggcgaccatccgaacaccacgctcaccgacgtgggctcggtcaagggcatggtccgcgatcaggtcaaggctgccgggctggggaagtgctacgtcggcgcccatccgatggccggcaacgaactgtccggctggcaggccgccgacccgcatctgtacgacggtgccctatgggccatcaccgtggacgagtccacggactaccgccgcttcctcgacgtcgccgcgatgatcaccaaggacgtcggcaaccgcgtcatcgtcgtggacgacgaaacgcatgacaaggccgcggcgatgatctcccacatgccgcatgtggtgtccaccgcgctgatcaacgaactggtcgccaacccggaccgcaacatcgccgccgcgctggccgccggctgctggagggacatgacccgcgtgtccctgaccgacccggaccgcacgcgcgcgatggtcgaggaagactcgctgaacgtcgaagcgctgctgcgccgcatggcggcacgtctgaccgatatggccgaccaactgcacgctggtgccgccggcgagcaggatgtgatgggattcttcgccgaaggcgaccccttccgccggtacaaggccgccgtgacacatgccggcatcaccgctgcacaagacgatacggccaccgctgcgccgcaagccggcacaactgccgccggattcccggaacgcgagctcgccgtccccgaagccggctggcagcagaccctgctgttctccgcacgccgaggagaagccatcaccggcttcgtccatccacgtcaggccatcatccaactgcgccccgccatgtaactgcgtaccgccatgtaggcccgtgcgcaggttcccctcgccgcctgtcacgaagaaggccgcgcgagggggatgaagttcccgcttgttttcgtgagaagaccgtgtggctccgctgttcgaaaggctcaaaggagtaaggtagtctgtaccgtttttcgggaaacgcatcgaagttgatgcggcgaatggttaagggggatgatgacgtatgacgttaccaaggcagattccggccggtgcccgcgtggtggtgcgcatcaccgacggcattgacccggtcgaccaccgtatgaagttccgcgactatgtgggtcacgtggtttcctgggacggatacacgttggagatggtgcgtgacgccgccgccaatggttcgcgcccggcccagaacgtgaccatccatcaggaacagattgccacattgaaacccgtgccggagcggcgcaacacgccaccccggccgtaacccaaggccataaagaatttggaggagaacgagagtgtcatctacgcagttcgacggcgatatcgactccttcgtctcctatctgaagtccaaccgcggcctgtcagcgaatacgctcaaagcgtatcgcgcggatctcacggcatgtctgcacctgttcgagctgcgcggcgtgaccgatctgaacgagatcacgctggatgatctgcgtagctggatggcggtggaatcgcgcgatcacgcccgcagcagcatggcccgcaaaaccgtggccgtgcgcgggttcttcgcgtgggcctatgagcatggggtgaccaacaccgacccggccgccacactgatgactccctcgattcccagcacgctgcccgcggtgctcaccgaatctcaagctgagcagttattggatgtcgccgaacaggccgttgcaacaaaccagtacaagggcgatgggggagcggcagccgcgtccggcagtggcagcggcaaggcagtcggcaagacagctgataagtcagccgacaccgtaaaccgcaacgaggcacccgcccgtgcagacaagcgcgacagcgcccgagtcgtcgccgaatcgcagcgcaacgccgcgattctcgaactactgtatgccaccggcatccgtgtcgccgaactggtgtcgatggatatcgttgacgtcgacttctccaatcgcaccatcaaagtcaccggcaaaggcaacaagcaacgcgtggtgccgttcggactgcccgcccagcgtgcgctggagacttggcttgaacaagggcggcctgtactggcccgtacggcaacggatgcagccaagtcccgtgctaccaacgccctgttcctcggcgcacgaggcggccgtatcgaccaacgcatagcccgtgacatcgtacacagagcggcccgagaggccggcgtaccggacatcagcccccatgcgttgcgccattcggcggccacgcacatgctggacggcggtgccgatctgagggaggtgcaggagatgctcgggcattcctccttgaaaactacacaacgctatacgcacgtctccatcgagcagctcaagaaccgttacggacaggcctttccccgggcatgaccactatgtgggcattggttaacaaacttagcaaagactgaacctagccggtaaaagcccccgaattttacatgggtgtaacaaaaatacgctgcttgtctcccaagtgcgcaaaaatgacaggtaacagcaacggggttgggtgtccgaagcggcgggaagcgtaagtgtcccgacgatgaggaaatccgaccccgttcgcatgaggcgaggctgaaacgcttcgcaacctaatgaataggagaaatcatatgaagaagaaagctcttgctttcgctgccatggcttgctccgtggccatgctgctgagcgcctgcggcggctccaacagtaacgctgcctccggtgacaccgctggctccaacatcatcactgcgtacaactccgaaccgcagaacccgctgatcccgggcaacaccaacgaaaccggcggcggcaagccggtcgacctgctgttctcccgtctggtctccttcgacaaggacggcaaggcttccaacgaagtggccgagtccatcaccccgaacgatgacgccacccagtacaccatcaagatcaagtccggctggaagttcaccgacggcaccccggtgaccgccgagtccttcaccaaggcctggtcctacgtggccaacgtcaagaacgcccagaagtgctcctccttcttctccaccatcaagggctacgatgggctccaggctgatggtctgaagggtgacgagcagctctccggcctcaaggtcgtggacgacaccaccttcaccgtcgacctgaaccagtccgactccgtgttcccgattaaggtcggctactcggccttcgccccgctgcctgagtccttctacaaggacccgaaggccttcggcgaggctcctgtgggcaacggcccgtacaagttctccaagtgggaccacaacaaggaaatcgccctcgtcaagaaccccgactacaagggcaacgaggacgtcaagaacgatggcgtgaccttcaaggtctacaccgacgactccgccgcctaccgcgacattcaggccggcaacctcgacgtgatggagtccgtcccggccgccttcaccaagaccttcaagaccgacaagaaggtccaggcttactccgaggccggctccgtcatccagaccttcaccatcccgtcctcccttgaccacttcaagaacgacgaggaaggccagctgcgtcgtcaggccatctccatggccctcaaccgcaagcagctcatcgacaaggtgctcaacggcaacgccaccgccgccaccgagttcacctccccgaagaccccgggctactccgactccctcaagggtgccgacaacctgaagttcaacgcctccaaggccaaggaactgtgggccaaggctgacgccatctccaagtacgacggccagctcaccttctcctacaacgccgatggtggtgccaagccgctttacgacgccgtcgtgaaccagctcaagaacaacttgggcatcgacgcggccaccaacccgatcccgaccttccaggaattccgtgacgcggtcaccaaccgtcagatgaagggcgccttccgtaccggctggcagcctgactacccgtccgccgagaactacctgtggcagctgtactccaccgctgctgctgatggcaacggctccaacgatggtgactacaagagcccggccttcgatgacctgtgcaagcaggctgctgccgcttccagcactgatgacgccaacaagctgtaccagcaggctgaggaaatcctcctcaacgaccttccggccatcccgctgtactactccaacgcctccggtgtggcttccctcaacgtgaagtccggctacgccttcgattggcagaacctcccgacctacaccgagatgtccaagaagtgagtctgactcactgaacggataccgctaggtagttcggaaataaagggcgaggatcgcaagatccccgccctttttgttgtgtgcggggtgcttgctcacgccatcgggaaccaagttaaagtatccactatccgaccgcaaccatggacatatccaccagcattgcccaatctcaaaccttgcgttaacgcaaatttacatatcacagtccgggcatgcggtaaactgtcggagtatttatcgaccggcgggggcgtactataccctttctggccggtctaggaaataaggagcaaccgtatgggtaagtatcttctgcgacgcattctgcagatgattcccgtggttctcggtacgactcttctggtatatgcccttgtattcgccctgccgggcgaccccgtcaaggccatgttcggagacaagcctgtcaatgaggccgtcgcagcccagatccgcgcagaataccatctcgaccagccgttcatcgttcagtacttcatctacctgaagaatgcactgaccctgaacttcggcgataccttcgccggccagcccgttctcgacgaaatcacccgcgccttcccggtcaccatcaggctcggcttgatggcgttcgtgttcgaggcgattttcggtgtggtcttcggcattatctcgggcctcaagaagggcaagtggtacgacaccgttatcctgatcgtctctctgctgcttatttccgtgccgaccttcgtcaccggcttcgtcatgcaatatgtctttggtattcagtgggcgatattgccggtgacggcaggcgccgaccccggcttccttgatctgctcatgccggccatggtgctcggttcggtgtcgatggcctatatcatccgactgacccgctccgaaatctcctccaacatcgccgaggattacgtgcgcaccgcacgcgccaagggcatgtcgaacggtcaggtcatgctgcgccacgtgctgcgtaactccctgattccagtcgtcacctacctcggccaggacatcggtgccctgatgggtggtgccatgatcaccgagcagatcttcaacatccacggcatcggcttcctcacctaccagtccattctgaagggcgaggcaaacctggtggtgtccatcgtcacgttgctcatgctgattttcgtagtgtgcaacctcgttgtcgacatgctgtacgcggccctcgatccgcgtatccgttacgcgtgatagggaggagtgagtcacatggcaaacgaaaccactgaaaacgagctcaaccagaccggcgagccaggaaccgaatacttcatggaaaccctgcccggtcaggaccgttacgtagctcctctcgacgagaccccgttgcaggacgtcgattccgtcgacgaatccgcaccggccaccagcatgtgggccgacgcatggcgaaccctgcgccgcaacccgttgttcatcatctccggcttgctgatcctgttcatcatcgtggtggccatcgcccccggtctgttcaccaagcaggatccgaacgcctgcgatctgggcaactccttgagccccgcctccgccggacaccccttcggctacgacctgcagggctgcgacgtgtacacccgcgtggtctacggcacccgtacctcactgtccgtcggcgtgctctccacgctgctggtcgtgattgtcggtaccctgatcggtgccgtcgccggcttcttcggcggttgggtcgacgcggtgctgagccgtatcaccgacatcttcttcgcgctgcctatgctgcttggcgccatcgtggtgcttcagatgttcaagacctccaagtccatctggaagatcgtgctggtgctgacgctcttcggctgggtcggcgtatgccgtatcgcccgaagcgccgtgctggaatcgaagaacctcgaattcaacaccgcttccacggccctcggctccacgcctgccaggaatctgttccgccatatcctgccgaactccctggccccgatcatcgtcatcgccaccacttcgctggcctcctacatcgtggccgaagcaaccctaagcttccttggcgtcggcctgccgaccaccacggtgagctggggtggcgatatctccagcgcacagaccaacctgcagactgatccgctggtgctgttctacccgtccgccgcactggccatcaccgtgcttgcgttcatcatgatgggcgacgccgtcaaggacgccctcgatccgaagagccgtacggcctgagcgaggggagtggagaaacattatgactgacaacaccaacgccaagatgctggctatgcagaaagagcatggtccgctgctcgaggtcaaggatctggccatcgacttcaccactgacaccggcaagccggtgcacgcggtgcgcgatgccaacttcaccgtctaccctggccagtgggtggccatcgtgggcgagtccggttccggcaagtccacctccgccatggccgtgctgggtctgctgcccggcaccggtcacgtggtcaacggctccatcaagctcgacggcgaggaaatcgccggcgccaagcagagcgagttcgacaagctgcgcggcaccaagatgggtctcgtgcctcaggacccgatgagcaacctcaacccggtgtggcgtatcggcacccaggtcaaggaagcactgaaggccaacaacatggacgtggctcacgaaaagcgctccgcccttgccaaggctctggccggcgacgaggtcgaagtcaagggcaacgacgacgagaccttcctcggtgccaaggaactgcccgagctcatgaccgaggccaagaaggctttgactgaagccggcgtgtccggcgaggccttcgacaaggccgtcgcccgcttcaccaacgaatgggttccgggctccgaaacccgttggcgcgtggccgacgacctcatcaaggccggcgtggccgacgaccaggcctggtatctggctaagaagtacgtcaccggctccacaatggatgaccgtatcgcgggtctgctgtccgaggccggtctgcccgacgccgctacccgtgcccgtcagttcccgcacgagttctccggtggtatgcgccagcgcgcgctcatcgccatcggcttggcctgccgccccgatctgctgatcgccgacgagccgacctccgccctcgacgtgaccgtgcagaagcgcatcctcgaccacctgcacatgctcaccgactcgttgggcaccgccgtgctgttcatcacccacgatctgggccttgccgctgagcgcgcccagcacattgtcgtgatgtacaagggtcaggtcgtcgaatccggcccatcccttgaagtgctccagcacccgcagcacccgtacaccaagcgactggtggccgctgccccgtcgctggcctcccagcgcatcatctccgccaaggagcgtggtgaggatgcggacgctctgctcgatcaccacatcgccggcgaaagcacgctcgaaaagagcgagcacatcatcaccgtcgaccacctgaccaaggaattcaagctgccccgcaagaaggagatgttcaaggccgtcgatgacgtgtccttctccgtcaagcgtggcaccacactggccattgtgggcgaatccggttccggcaagtccaccgtggcgaacatggtgcttcacctcctgaagcccacctccggcaaagtgttctatgaaggtcgcgacacctccacgttcaagtccaaggaccttctgggcttccgccgccacgtgcagccggtgttccagaacccctacggttcgctcgacccgatgtactccatcttccgttccattgaggagccgctgcgcatccacaagatcggcgacaagaagtggcgtgccaaccgtgtcaaggaactgctggacatggtcgagatgccggcttccgtgatgggccgttacccgaacgagctctctggtggccagcgccagcgcatcgccatcgcacgagccatggctctggacccggacgtcatcgtgtgcgatgaggccgtgtccgctttggacgtgctggtgcaggaccaggtgttgcgcctgctcaacgatctgcaggccgaaaagggcctgagctacctgttcatcacccatgatctggccgtggtccgccagatcgccgacgaggttgtggtgatgcagcacggcaagctcgtggagcacgccaccaccgacgaggtcttcgaccacccgcagaagcagtacacccgagacctgctcgacgccatccccggcggcaagctccaactcggtctggactgataatctgcgtttgagcgcattgtattgggttctttccatccgtggaaagaacccaatattcgtatgtgcaggtttgcattatggttcgcgtgggacgaaaacgcaaaaattggtgttttcccgatgttgtcccacaatttgtgggacaacatcaacatcaatcgatagacatgagtgttgtcccacagcagatttctcacgaagtccggaattacgccattcttagtgtggtcgataattactcatgctgtggggtgtgggacggcccgcgaaaatcgtcgattttcggatgttgtcccacggaatacgtcatacctcgtatgtgatcgtgagtggggcgtgatcggaccagcgtttgtcatacgtgggagccttgtcgatgacgaatccgcgtgcggtctccgccaactcgggcgtggcgaactggtagtcgattctccagccgacattgttgtcgaaagcgcgccctcgctggctccaccaggtgtatggcccctgaatgtcgccggccaacgaacgcatcacatccacgaactcgtattcgtccagccatttgtccacgtaggcacgttcttcgggcagaaatccggcgtgcttctcattggccttggcgttcttgatatcaagcggcgtgtgcgcgatgttgaaatcgccgcagagcacggcctgtttgccgccatgcgcagcctcgtcccgcaacgcgcccatgcgcttcagcatcgtgtccagaaaacggtacttctgttccattttggtcggataatcggtgttgccagcatgcacatatacggatgccacggtgatcgcgtagccctcaggcgttttgacatcggtttcgatccaacgccctgaatccacatcctcgctcagacctggcagcccatatcgcttgtcaagcacttccaagtcggtgagcagtccgactcccgcgcggcctttcacccggcagacctcgttcatggcatggaggttggccggtgcctcgatcttgccggcggtggcgtattcgaaaccaaattcatcgaaaatagaatcgacatcgtcctgaggcgcgcgaacctcctgtatgcaccagacatccggcgcatgcttgccggcccaatcctcgatgcccttgcgcttggccgcacgaatgccgttgacgttagacgtggtaatggtgatggtcatgcggccatactattttggcctccctacgaatcgaaccggacatcggcggccgcgatgctcagctttctctaagcctgagtgctagtgttagcaaggttgcaaccgttacatgaaacgaggaattatgggactgttcggattcggcaagaagaagagcaagaaggaagccgagccggccgttgagcctgtcgatgaagacaaggcggttcgaacacttccaaccctagacaaggtgttgcacttctatttagaacccgggctttttaatgacaaacgataaattatggtataatgcaagtatgagttgcttggtttgcgcaatgaagcggaggctcaatcatggcaacgacaaagaaactatccttcggtttggataaggccggtggcgcggccttgatcctggcccgcatcggtgccgcgctcctatggatcatcgcagcgctcgcggccgtggtgtgggtggtattcctcatttccccgcgctcgttcgccgcgaacttcggcagtgtcgacctgaatgtcggcggcgcgttcaccctcagcatcaagggcgacttgttggactactcctataatctgcagaacttccacgacggtcccgtcaacatggtagctaccatctccaccggtctggcgagaatggtggtctacgctctactggccttggcgttctccgaaatggccgcactgtgcaaggatttgacggtgtggcttgcagacggcagggatgccacgcctttccaaggcatggtgtccgaccggttgaacagggctggctggtatctgattgtcgcgccgattgtgggtctggtgaacttcatcgtatgtttcctggctggcacgggcggcaactggggcttatggatgagcggcatgatggtgatgattggcattatcctgttgctgattgcgcgcatcttcgattatggcatgggtctgcaacgggaagtcgacggtctgctgtgagggggaagagcgccgtaggcccgcgtggcgccggtccgaacagggccggtccgaacaccgagggcccgaatgaggacagcctgaacatcgttgattcgagcgagaccggcctgaatacggctgactcaaactccaccggtccggccggcataggccatatcgtcctgcgcctcgaccgcatcatggtcgagcgaggccgctcactcaactggctggccgatcaggtgggcatcaccaacgtgaacctttccaaaatcaaaaacaatcgcgtttccgccatccgcttttccgccctcgccgccatctgtgcggcattggattgccagcccggcgacattcttgaatatgtggatggcatttcgggcgatgcggacgatgcgaatagcaagtaatcgcacgcatgccaactcttctcctcctggcctgtgattgattgacaatcagggattacatgccaaatgggagagataaacatgtggaggttggattggatgggtgcagaagttgcgaattggccccatccaaattggactggtttgggtggggccaatccactccgttcaataatgaagcgcgataccaagcagcgtcgaacgaagggaaactcatgacgcagaatcgtgcggaactcaaccgtaatttggcccagatgctcaagggcggcgtgatcatggacgtcaccacgcccgagcaggcgaagatcgctcaggacgctggtgcctgcgcggtgatggcgctcgagcgcatccccgccgacatccgtgccgccggcggcgtttcccgcatgagcgacccggccatgatcaagggcatccaggaagccgtgtccattccggttatggccaaggtgcgtatcggacacatcgccgaggcccgcattctgcaggccatcgaaatcgattacatcgacgaatccgaggtgctttccccggccgacgacgtgtaccacatcgacaagaaccagttcgatgtgccgtttgtgtgcggtgcgaagaacctgggcgaggcgctgcgccgcatcgccgagggtgcagccatgattcgcaccaagggcgagcccggcaccggcgacgtgattcaggccgtgcgccacatgcgcaccatgaacaagcagatccgcgaacttgtcggcctgcgcgacgacgaggtctacgaggccgccaagcagctggccgtgccctacgatctggccaagtacgtgcacgacaacggccgtctgcccgtcgtgaacttcgccgccggtggtgtggccaccccggccgacgccgccctgatgatggaactcggtgccgaaggcgtgttcgtgggctccggtatcttcaagtccggcgatccggccaagcgcgccgccgccatcgtcaaggccaccgccaactggcaggacgccgatctgctcgccaagctgtccgaaaacctaggcgaagccatggtcggtatcaacgaggacgagattcagaccatcatggccgctcgcggcgagtgagtgcattaccttggctcccctctttgaggggagccaagaaagggtgacgctcccgccagcgggagtcaaggcccaaggagacaacatggttgtagctgttgaatatatttccaaagaagagtctgcggacgtcgaaaacgtcaagcacggcgtgaccggcatcctggccgtacaaggcgcattcgccgaacatgcggcggtgctggacaagctcggtgcgccgtggaaactgctgcgcgcggccgaggatttcgatgaatccatcgaccgcgtgattctgtctggcggcgaatccactacacagggcaagctcctgcattcgaccggactgttcgagccgatcgccgcccacatcaaggcaggcaaaccggtattcggtacttgcgccggcatgattctgctggctaaaaagctcgacaatgacgacaacgtctactttggcgcgctcgacgccgtcgtacgccgcaacgcctatggtcgtcagctcggtagtttccaggccaccgccgattttggtgcagcggatgatccgcagcgtatcacggacttcccactggtattcatccgcggaccgtacgtggtgtcggtcggccccgaggctacggtcgaaaccgaagtcgatggtcacgtggtgggcctgcgccaaggcaacatcctcgccaccgccttccatcccgaactcacggacgacgtccgcatccacgagctcttcctgtcgctgtagccgattcgtctgccgttagactggtattcgaccgacgaatcaaggagacgatctgccatgcagttcacgctgaaccggcgcagcacggtgccgatgtaccggcagctggctgctgagctgcgtgaacagattgtctccggcgcaatggctgagggctatcgtctgccgcctgaacgcgagttggcctcacgcctcgaggtcaatcgcaccacggtattacaggcctatcagcaactcaaagatgagggactcatcgcctccaaagtaggcaaaggcacgttcgtgctgccgttgcagcatattgagactgcccggattcctgtagtgagacatgagccgattgacgaggagccgaaaccgagcgttgtgcggccgccgtggtcggtgttgttctccgactattccaaccgattcacctaccacgacattgcctcggccgagcgggcgcaacgcggcgataccatcatcgactttgccaccggctcgcctaatccggcggatattcccgacgatttgttgcgttcagtgagcattgaagcgtttgagtcgcgcgaattcgacggtcagccagaatcgcctatcgaaggattcgatgaactccgcgcattacttgccgagcatatgagcacacgcggcgtgcagtgcgatgtacgaaacgtgatggtgctttccggttccgagcaaggcatcgatcttatcgtgcgtgcattcgtcaatcctggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgcctggaactgcttaaagaaggccgcgtcgccgaacatttgcgcggtttgattaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgctggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggtttccatcctgccctcccgtgcttgtattcgctatgggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggtcttcgccgtcggattggcgcttaacgtcgtcacctccaaacgcaccggtcgcgatggcgaggcgcccagcccggccagtccgcgcgcgatttccaacgtcacatccaccggggaatcggagatattgacgattttgatgtaacggcaggcgtcatccctgtcatgcccggtggcgctgacatacagatgtttggcggggcgtgacgcggtctgctcgatggacacggcatacgtcgtgtcgcccagatgcgtggaaaacagccgctccacctcataattcaccgtggggttcacatgcgccggattgaattcgataagattctgcgcccaccccttagccggaatatgcgcgagcagcggcgcataggaggtcatgcgcaccacgtcggaattgcgctcgcagccggtcaggaacgcggcctcgccgagtgccgacttccacgtgttcgcgccttgttcggtctgtggttggccggcaaaatagccgttggctgaatattcgccgaaatagacgccggcgccacaacgcgggtaagcgtcgaatcgtgacgcctgggatgcaaaccattcgggggagtggtaggaatgctcgtcgacgataatcgcgtcaccggtggcggaatcatgtgccccggaatcggttgcggccaacgctcgcgcatggtcccagctgcgcttcatcgccggctggaaggggaacagtccggcgctcatcacacacagcatatccgggtatcgttcatgaatggcctcgctgatcatgtcaaacttggccacgtagtcagccccgaagttttcgttgcccacgccgatcatgtccaagccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtaggcagcggcttggccttgaggtcctcgcacaggcagaaatattcgtagaaaccgatctgatagctctgcgaatagctggaaccatccggcatcttgaacgaccacatcgaatactgttggcgtcgcgcggccagagagccgacggtatccttccagcgatactcattgccgggcgtcacaccttcgacgatgcagccgccggggaatcgcagaaacgctggatgcaacgcctgaatggtctccaccaaatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatgacgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccaaggccggcggcggaacagttgatgaaatcccagaaacgcagggaatcagcctgcgtacgccaccgttcggcaccggccatacgccacgtgtgatggtcgagataaacgccgtcaaaactgtagttgttcaccatgttggcgttcagcccgccatccgcaccatggttgatgtcctcgaagaacacgccgtacagtcgcccgcttgtgtgatgggtggggcttcccacgctaatccgcaccatggtttcgattgtagagggaatggagcggaaaggtaaacggaagagttcgctcaccgttcatgttgcggtcaatccaagtcgactgttcgccggtatacagccggtaacctcgaaacaggaatggaaaatacggacgactaggagcgcggctgtgcaatcctcggtgggaatacgtgagcgcatcgaccacgtgtatccgtcgctgcgtccggcggagcgcgccgtagcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccgactatggccggttctccaccgcgctcgacgaatccggtcgcatgattcgcgaccgcgtattcgagaactgagctgctgctttatcgcgccttgggccgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccctgccttcactggcaaaacgatcctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaaccgtcgaccttgagattagaagtcacatgctcatcaccaccatccgggaacacccttaaggggtgcgtctcctgcataacggctatactctgacttgagatgtgctgaataataaccagctatcgcgcgtccgccaatggcgacgaacgagggaagaaggcccgtgccacgagcaatcatcgaggtaaaaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatctcggcttcgtattccagtcgtacaatctgctgcccaatctgaccgcgctcgaaaacgtggcaatgccgctgatgttccgcggcgtgcccaaggaacagcgcgaacgtgcggcgcgtggcgtactcaaacgagtcgggctcggccatcgtctcagccattacccgcgccagatgtcgggaggccaacagcagcgcgtcggcatcgcccgggcgtttgtgaccaagcccgaggtggtgttcgccgatgagccgaccggcaaccttgactctaaaaccaaaaccgaggtcatgacgatgatctgcgcattcgcccatgacttcaaccagaccatcgtgctggtcacacacgatccgcagatggcctcatacgccgaccgcatcgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcggtcgacggcacagacggcacaagcggcacgaacagtacgtctcagggaagcgacggcgattccgcgccgatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtccgatgtcaagatttccgtgccgatcagtcagcctgaccggttcgaaatcagtgatcccgtagtgcccgaccaggtgatcgccggtcaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgcctttacgccgcacgcgtcaggcgagctgaagaccacgctcaaagtcacgtacgaggattccgacgggcagaccaaaaccaaggaattcccgctcgccatacccgtaaccgatatgcagccggtggatgattccgacatggccgatccgaacatggaccagagcgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagtcaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgattgtgctcatggtctctttgggccagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagccggcgcgggcggccgttacctctacgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctatgatcaagtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggcgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgcctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgtcagaatcgcctcgcccggcactcgaatcaccaccggaccagcaggggcgtccgccgaaccggccggcgcggtagcccatgccagatcagctagatagtcgcgagccgaagtcggcaccagcatcgtagcccctggaatattggagaacatcgtcacgtcatacgcgccggaatgcgtattgtccgaaccggacaggccgcccagaaaatcaagtaccgtgactcgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcctggctcggcggcgaaacgcggttcgagtgcggccatcgccattttgccgtaatgcttgcgcggatcgtccggcttgccgattgcggcatccggattctgccaatgcgaggcctcgcactggccctcatgcggttcatgatcggacaggttgcagtgatccgaatgccacggctcgctgtggttcacgttatcggtgggatgcacgccggtgggggagtcgaacgaaaccggtgaggccgaggcggtttgccgatctgcgtgagtctcctcaccgtcatatcctgcgcccttcagcgtatgaatatggaccaccaccggatgatcgatatcgcgcacttcctcgaaagctgcgaccagcgcggaaacatcgttgccggcctccacataccgataatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgcggcgaatcgaatacgcggtgcagggccaccgtggcctccaccatgcccagattggagccgatatgaccgccgtgttggtggccatatgccagcagcgtggcgcgaatctcgcggcacagttcggcgagctcgtcgggggcaagggccttgacatcggccgggctggcaatgcggctcagcagatgggagtcgtcgccatgggaaggggtaatgctcggggggatgtcgtgaaggcgcacggccccctcggcggcaccggagacggcgaaggaatcgcttgaatcaaatccgtttcctgacgcgttgcgcataccctcgaatctcccttcgctagtctttccgaagttgaatgctaacgcccggcattgtccgaggtccacatgacgaatcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgacgatccgcttgccgcgttggcggtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcgttctggacgaggacatccccggcaagcatgggctcaaggctggcagcgaagtggtgctgtacacgttcgtcggcaccgatggggcgggcgtggccccgggcgagcgccgtacgatcctctccgagaaataccccggcacgatggccgagaagacttccgtgccgtccgccaacgtgttcgccaagcccgcaaacctcaccacggccgaggcggccgcactcggcaccagctggctgaccgcctactcgctgctgttcgaggccgccggcatcaagccgggcgactccgtgctcatccagggcgcgggcggcggcgtgtccactgcggccatccaactcgcccatgccgccggtctggaggtgttcgtcacctcgcgtgacgcggacaagcgctccaaggcgctgaaacttggcgcgaacgccgcgctggagaccggtgcgcggttgccgcgcaaggtcgatgcggtgatcgagtccgtgggggcggccacatggggccattcggtgcggtcggtgcgtcccggcggcaccatcgccatctgcggcgccaccaccggcgaccagcccggtgccgaactgacccggttgttcttccaggacattcgcgtgcagggctgcaccatgggttcgcgcgaggatttcgcacgattgctgcgcttcgtggagcacgccgacctgcatccggtgatcgattccgtggtcgacggattggactgcgcccccgaggcgttcgccaggatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcctccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtaatcggcgtgcccgtgcgctcccacgccctgtccggctgggattcgctgctgtccatcgtgcagatgcccggcggcattccggtggccaccaccgccgtcggcaactccggtgccaccaacgccggcctgctcgccgtgcagatgctctccgccttcgagcccgaactggccgacaagcttgaggattaccgtaacgaactgaaagaaaaggtagctgaatccaatgcccagcttgtctgaggaaacaggcggtcgtgtttcgatgctgatgccgggatcgaccatcggcatcatcggcggcggccagctcggccgcatgatggctttgtccgcccgctacatgggcttccgcgtcggcgtgcttgacccgacgccgaactgcccgaccggtcaggtggccgacttccagatcaccgccgaatacgatgacagaaccgccatccacgatctggccgtgcagtccgacgtgctcacctacgagttcgagaacgtggacgccgacgccatcgacgaggtgcgaggcatcaccgccaccccgcagggcaccgacctgctgcgcgtgacccagcaccgcgtgcatgagaagcggttcatcaacgaccacggcaccgccaccgcaccgtggcgcgccgtcaacaacttcgatgagcttgacgccgcattggatgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcctctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatatatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagccaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactattgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaacatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgagccgacagacgagccagcaaggcgcggggcgtagcccgtccaaaattgcagtagcgctaccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggtgaagcacagttcgtgcgcaatcgtctgagcctttggaccgcccggcatcccaaagcgatgcattggatgttgcagccggctgccggatggacgattgccgagcccaaaggcgtggtgctcatcattccaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgctttgagcagcgtgtaggcaatggtgtgctcgcgcgcgccggagccgataaccaatactttctgacccatgttgttcctttcctgcggaaagcgagttacttcagtacgatttgcgtgccggtggtgtcggcggtgatggagccgagcacgtaggcgggctcgttgttgtcggcgagcagcttcagcgcctcgtccttgcgagcggggtcgatggccagcaccatgccgatgcccatgttgaagatgttgtacatctccttatgatcgatgttgccggccttctccagcacgtcgaagatcgggagcacgggccaggtgccgagctcgatttcggcggccaagccgtccggaatcatgcgcgggatgttctcgatgaagccgccgccggtgatgtgggccacgcccttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcgatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttacgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtccgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacgtggtgagtggcttccgtgcggccgtcatggccgtcgtcgagatcgtcgccgcgggcagaaggcccgacagggccgcgatcgaccagacggccaggcggatcgcgcagggcgacggtcccgaatcgagggccaggctcgacacgtacagcaggttcatgagggaggacggcgatgagtgagtcgacggacgccgcggcgggcggacgcaggggcgggcggaccgtgagcaagtccaccccggacgaggtcatggagctcgcatgcgggctgccgttgaccaggagcgtgctgcgttccgtggtcgcgggcgccacgcccggccagctcggcgtgctggccgacctgttcagggccgagaacgccagccggacggaatccaggcgcgccaggctgatcaggaacgcgggattcccgtgcgtcaagggcttcgacggatacgactggggcatggcgtcgttccccgccgactgggggcgcgagcagctcatggacctcggtttcgtgggccgggccgaggacctcgtgctctacggcgacgtgggatgcggcaagacgcacatggcgatcgccacgggcatgctggcgtgcgagaggggcatgccggtgaggttcttcaccgcgtcgtcgctggtgatgcgtttgcggcgggcgagggacgagaaccggctcgacgcggaactgcgcgcgataggccgcgccaggctgctggtcatcgacgagctgggctacctgccgatcgacatcgacggggccaggctcctgttccaggtcgtcgcggattcctacgagaagcggagcgtggtgttcaccacgaacctggagttcggacggtggggcgaggtgttcggagacggcgacatggccgccgcggtcatcgaccgcatcgtgcaccacggaaggatcgtcaggttccgtggcgagtcataccgcaacagccactccctgatgaaataaacgaaaagagcggaaccaacccggccgccggtgacggtgtccattttgaacgccgatggtgttcagattaactggtgacgacacgcagatttatttgacgaaagacagtcgaatggcagtcgaacgactagaccgccggacacacattttggcctataacccagaacaaaaacccttggaatcggactgattccaagggttttgttgtgtctgtggagctagccgggttcgaaccggcgaccctctgcttgcaaagcagatgcgctaccagctgcgctatagccccgtgagaaaaaaagagcggctcgcggccgcttcatttttcccgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggcgcagcggagcatgacgagtgcgatgaggctgttcgcgtggtggaagccgtaggccatgcggatggtgaccttgatcctgttgtcggacgcctcgagcctggcgttggagtagcccagctcgatggtcctgaggatgtcgggccacgacggcggatcttccgggatggcttgccgctctcgtacaactgcacgatctgccgtttgaacgcctcgtcgtagtggcggggatgtttcgggtcggccatcgtcggcctccaatctcatgtcattcgtccctcatcggactgtctaatacgttgtagccaatccacggcgtcacatcgtcaggctgtccgggtcgaggaggaaatcgtagacgctcatcgtgaggatgccgtgctcgtcgcggacgggtttgaccacgtcgcgtacgaggacgatcttctggaagctgtcgtcgatctcgagcagcgaggcttctcctgcgcgaccttctccggtgtgggcagttggtacgcggattggtcagggcgccgatggaggaggccagcacgtcgaccaggtcgtcgagctcctgcgacctgcgcagcccgttgcgcatgcgcagcagcccgttgatcaccccgtacagacggggcggctcctcgccgcgcgtacgaacgcagttcatgaagaattacgagtgattcgtcgaagtcttcggcgttacggccgccgcctgagccagggcggcggccacttgttcgttgacggctccctgctgtgcgatggtgacgcggatgcctcgactggcatgcgcgtccacgcccgcaccggcccccgcgtcggctccggtggcgtcggcgctgatacgcaggctcggcaggaacggcttgccggcggccacacggatgccctgttcggccagcagtcgcagcgccgccggctcgtcgcgcaccggaatccacagattcagtccgtcaccggtatgcacgtccaaactttgacgcagcagcagcgcgtgcatcgtcttttgccgggtggcgtagatatgccgggcgttggtcaccgtgtggaacgcctctttgtcggccagcatttcatacagaatctcttgcaggaaccggctcacccatcccgatcccaagcgtcgttgggcgataatcgcctccacggcatcctccggcccagacagcgcagccaagcgcagatccggcccgtgcgacttcgaaaaactgcggatatgcaccacgtgttgcggcaatcgttgcgccaacgatgtcgcatacgcattggccacatcgccactgtgatcgtcttccacaatcagcggcataccaacgccattcgggtagtgcgcgagcagcacgtccgccaaagcgtcgatgcgttgcgggctgaagctggccccggtagggttctgggcgcgcggctgcagcaggatcatactgacctgatggccgccgtgcggcaccgccagacgctgcgattccagcatggtcagcgcacggtcgagtgcgtcgggcagcataccgaacccgtccatcggcacgccgaacgccatcgcgccatgtgcctcgatcatgtcgagaatcagcggatattccggtgcctcggtaatcacaaaatcacccggctgaacaaaagcgttcatggtgtgcgccaaaccgtcgcccgcgccggatgccatagtcatcgcctccggctcatacggccagttgcgtcgcaaaatctgttccagcatgggcaggatggtcggcccgtcgtatgaattgacgaatgccttgtgcgtgccgagcttgccgagaaacgggcggatgtccggcagcagcgaaaggtccggcgtgcccttggacaggtcgataatcggtcggtccggcgcggtggccggggcttcggccagcaagtcgccggcatcgtagcgatgcgtgcgcgactgccgcagtacgaatgttccggcgcgcccgcgggagcgcagtatgccggacctggcgagggcatggtaggcactggagacggtggccggactggtgcgtagcagtcgggcgagatcgcgtacggtgggcatgcgctggccttccgcaagtatgccggaggaggtcagcgaggtgaccgattcgacgatgcgttgcggggtggccgtcgcctcggtggtgaggatgagtgaggataactggccggcatcaacggccaggtcgtcggtggaacgcaggggagcggccgtaatgcttggctcatcgttgtagccgacggcatgtgcggttgttgatgcggttgatggcgatggcgtatccatgatctgcctcccggatcttggcggcgagcgtgatgagcgcgcgtctgcgtgaatgttgccgattgccgccggctgatgatcgatggcggttgccggcttgttgctggctgcttgactgccgatagtaacggtcactgtggcaacggtagtcaaatgttagcgccgcattgtgcaatgagtatgtttttgaataacataaacattacataatctggatacaattattgttcttgttcctatgtttcaaaatgatttcgtattcgccactactgtaacattattaaatgttcgagtttgacgcgaaatgttcaactctcataatgacattcacagcgcgttgctgccctgacccgatccacgggagacggcatcgggcacttcgagaaaatatcgaggaaaggacacatcatggggcatgatctttcgcaggatgcggaaatctgggacgacgcttacaagctggaccgcgcacacgtattccattcgtggcacgcacagcgcaacctggatcccactgaagtggtaaccggtcacggcgtgtggctgaagtacggcgacggccgtgaaatgctcgacttcaccagccagcaggtcaacgtcaacatcggctaccagcacccgaaggtgatcgagggcatcaagaagcaagcggaactcctgtgcaccgtcggacctgactacgcgaacctagcccgtggccgcgccgcctccctggtggcccgccgcgctccggaaggcttcgacaaggtgttcttcaccaacgctggcgccgacgccaatgaaaacgcgatgcgcgccgcccgcctgttcactggccgcgacaagattctgtcttcctaccgctgctaccacggcaacaccggtgcggccatcagcgccaccggtgactggcgccgtaagcccaacgactactctcgcggccacgtgcacttcttcaccccgtacctgtatcgctccgagttctccgcaaccacccaggaagaggagtgcgagcgtgcgctggctcacctcgagcacgtgatccagttcgagggcccggacaccatcgccgccgtgctgctcgaatccgtgccgggcaccgcaggcatcatcattccgcccaaggactacttcaagggcgtgcgcgagatcaccaagaagtacagcatcctgatgatcaccgacgaggtcatggccggcttcggccgcaccggcttctggttcgcactcgacgactacgactacacgccggacatcatctccttcgccaagggctgcaactccggttacgtgcccgccggcggcgtgattatgagcgacccggtggcccaccgcttcgacgacatcgtcttccccggcggcctgacctactccggtcacccgctggccatgggcgccatcgtggccacccaggaagccatggaagaggagcacatcgtcgacaacgcctacaccatcggcaaggacgtgctcggcccgcagctcaccgctctgtacgacaagcacccgaagatcggcgaggttcgcggcaagggcgtgttctgggccgtggaaatggttgccgaccgcaccaccaaggagccgctggacgacgccacgatgaagcagatcgtggccgaaggcgacaagcgcggcctgattctcggcgtgcacaacaaccgcatccacgtcactcctccttgcgtcatctccgccgacgaggcgacccagggcgtcgagatcctcgaccaggtgctgaccgcggccggttgctgattgggtgactcaatggctcggtgacggtttgtagccgttgccgacagcaccgttcattgctgatggcggcccgttcggaacgttaggttccgggcgggccgccatcgttgtccgccgttgtgcgagaatgacttgcgtgccttatcgccgtcgtcaatccaccgctccgaagtccggtgcgccgaaatccgttcggttcgctgccgccgggcagtcgttggatattgatggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggcgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggaccgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgattggattcgtcgacgatttgccgcatggcggtttcggcaccgtcgccgtcgcccttgcgaatcagtgcggcgacttccgtatgccagcaagggcgaaccgatcggtccaaacgggctactcaggccggccagcccagccagtccgttcggaccgatctaactatcagagcgggccctccgaccggtccgaaccatctgaccgacctaactgatcagagcgggccctctgaccggtccgaaccatctgaccgacctgtattgttgactaagtgtgcggcccgcatacgggcctgccactcgctgttgaacggacggctacatttttgcaaccacagaaatacggttccagtcacgttttccaaacataagatgcggttttgtctacgttttccaacctcaaaatggggaggtttatacacttttccaacttatgtatgtggagactctctatttcacgtgagacgaaagtggctcccctctttgaggggagccacggaatacggcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcgtagtactcgatcagcgccttgagatactcctcggtgcccacgcggccctcagcgtcgaacgatttccacgtgcggttgcgcacgatggcgtcagcacggccatccggggtgccgcccagagtggcaatgcgctcggcggtctcgtcggcctgggccagcacggcctcgacctcggggtcaagcatctcgtgaacggcgatgaagttcgggccggtcacgttccagtgtgcgtgcttcaggaccagagcggcctcctgctcctggctcagtcggttctgcaggatggcgatggccttctcactggccgcttcatcaaggcccggcacaacaaatgcaagtgtcataatgttccttctttcagtaggtggaacgttgccctttcattctacgttttttggttatgccccgggccgaacgaataggtggtgaatatcacgcgactatttggcatcgtcgctttgtgattcggccggcagcggcgcatggtccggggcgccggctttgcggacttcgatggtttcgatgcggcggccatccaccttggtgacgaccatgttgtagccgtcgtcggaatgcagcacgtcgcctaccgctcccatcttgccggtcttggacaggaagtagccggcgaccgtctcgtacgggccgtcctccaattcgatgccggtcagatcggcgaagtcctcaatggtcatgctggcctcgatcgtggccacaccattgacgaacgcggtgcgggtggtgcgttcgccgcccttctcgctgggcagatcgtactcatcgcgaatatcgcccacaagctcctcggtcatatcctcaagcgtcacgatgccgtccgtgccgccgtactcgtcgatgaccacggccagatggatgccgcgcttacgcagcagttccaggctcggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgtgggcgcatcacctcggcgacgatggtttcggacgcgtcgaacacatcgtccagaatcgtgcgttcgtccttggagaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggaacagtaggagatgatgagggtcaggatgatgttcaccaggccgccggcgatgccggggtgcacgccccagctttcgaccgccggaatcaggtagggggcgatggaggaggcgccgaacgaggcggacaggaagccggagagcgtcacgccgatctgcacggtggacaggaaggtgttcgggtcacgtgcgattttggcgactttggcgccgcgagcgtcctcctgctccatttgctcgatctgcgagccgcgcagagagaccaatgccaactcggtgccggagaacacggaaccgataacgagaaatacaaaaatcaggaggatgttcaaaccaagtgacatggcttcaactctaggggagtggcacgtcaaattggggtgtgctggctgggcagtaagaaactcggcaaagggaagggcactcttatcattaccgcggacgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggtggcgatattgcggatcgcacgctcagaagctcagcacttccactttgccggaatcgagctgatagcgggcgccgacgatcatgagcttgtcagtggcgagggcctgctggatgacaggagactgctccaccaaagtttcaataatgtgggccacatgcacgcgctcgatatcttcatgcgcgtcgagctcggcttcgcgcgcctgccagacggacataccggtctggcgcagaataatcgattcggcggaggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcttggcacgacgccaacgagaagatcgccaagatcgagtacccgatgcttgccgacccgaccgccctgctggccaaggatctcgacacctacaacgaggccgatggcgtggctgagcgtggcgacttcatcgtgagcccggagggcaaggtcgtggcctacgaggtcatctcctccaacgtgggccgcaacgccgaggagctgctgcgccgcgtgcaggcctcccagttcgtctacgagcacggcgaccaggtctgccccgccaactggacccctggcgaggaaaccatcgagcccagcctcgacctcgtcggccagctgtgatcgacactgaataggcggtaaccttggctcccctctctgaggggagctgtcgctgaaagcgactggggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggcctgctggcctgacggccggcctgtacctggcccgcgctcgctaccgcgtgctgattctcgaaaaggacgatttcggcggccagatcaccatcaccaacgaagtcgtcaactatccgggcgtgggccgcaccacgggccgcgcgctcacccagaccatgcgtcagcaggctcaggactttggtgccgaattcctctccgccgaagccaccggtctcgacgtggatggtgacatcaaaaccgtgcacacctcacgcggcgacctcaagacgttcggcatcctcatcgccaccggcgccagcccgcgcaagctgggcttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggttgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacctcggtgccgggcgtgtacgcggccggcgatctgcgcgtcaagaacctgcgccaagtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgagctggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgcccgaccgtgcgcatctgcgtgccggctgagggcgacggcaaggccggcaaggacggcaatggttcactggtcttcaccggtctggccttccacggcgtaccttccggccatgagttcaactcgttcgtgctcggcctgtacaacgcggccggtcccggccagccgctgggcgacgacctgatcgaacgcgcgaagtccatcacagacccgctgaacatcatgatcctcgtctcgctcacctgcacgatgtgtccggaaaccgtgcttgcttcccagcgcattgcctccctgagcccggccgtgcgcgccgaagcctacgacgtctcgcacttccccgaactcaaggaccagtacggcgcgatgagcgtgccctgcatcgtcatcacccacgccgacggcacccagcaagttgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacaacgaacaggccggtgagcaccgggatgagtgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcagggataatcgcgctggtccaacgattctcggtaaaccttgccatatatgggcggatcctttcgtaactggtgtacgatggcctgccggcccgaacgagagtcgtatcgcccatatccacgcacatcacgacggcatgcccccgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcagcgcgtgcgtgacgccgcccgcaaactcggctacaaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccgtcgacaccgtgaacgcgccgagcgacgccggctcacgggcggcaatcgaacaccttatcgcgcgtggctgtgcgcgcatcggcatcgtcggcgacaatcacgatcccaacaatcccaacatcattcccggctcgcgtgatattcgtatgcgggccgccaaggagacgattctcgcggccggactgccgtttgacgagcgccgtgatttcatcaaatcctcgtggtcgattgacggcggtatcgaggccgggcgcggcttggccaagaaaggcaagtgcaagtacgacggtctgtactgcctgaacgacggtattgcgctcggtattctgcgtggtctggcggacgatggcgtaagtgtgccgggcgatgtgcgcgttatcggcttcgacggcctgagccagagcatgtacagcgtgccgactttgaccaccgtggccaccgatttcaagggcatggcggataccgcgctgaccttgcttatgcggcgtatcgagaacctggacgacgagttcttcccgcagaccgtgaatgtgggctataagctcatcgagcgtgagtctactgcggcgtgaaatggcgtgaaacagggaagtcccactctggcgagtgggactttaccgatatgcgcgggtaaaaggaaacccccgctgagtcgcgggggttgctgtgctgcgatatgttttgcgcgcgcaaagctattgcgcaaaacatatcgctacgttttggccttgggaagcccaccgggcttcccaagcggtgttgggccgcacgcgcggcccaacaccggccaaaacgtcagcctgtgttctgcaggccagcggcgacacctgaaacggtgcagaggatcagatagatgaaccctgcctgctggctttgcgagagctcttccttgtccaccttcttgcgcagcgacttgagcgccagcacctgagtgacggacagggcgtccacgtacggagagcggatgcggatggcctgaccgagcacgtgacggtgctgcagcggccacttgtcgccgacgatgtcgagcacccacttgcgggtgagctccatctcgttcagcaccttctcgttgaggtcctcgcggtcgccgagggcgaggtacatcttggcgatgcgctcgtccgtcttggcgatggacatctcgatgttgtcgatgaaggtggagaacagcggccattcctcatacgccttgcgcatggtctccagatcgccgaacttctcgcatgcggtgccgagaccgtaccaggcggccaggttgatgcgggcctgagcccaggagaagatccacggaatcgtacgcaggtcgtcgagcgacttggcgccgaggccacgcttggccgggcgggagccgatcggcagcaggccgatttcggtcagcggcgtgacgatcgagaaccacggggcgaagccatcggtgttcaacaggtcgaggaagcggttgtgcgcggcctcgtcgagctgagcggccatatcggcgtacttctcggtcatctcggtgttgcgcttctccacgctcggcgcggactgcagcaaggtcgccgcagccacggactcgacgtggcggatggccagcaccgggttgccgtagcgggcgaagatgacctcgccctgctcggtgagcttgaagcggcacttgacggaaccgaccggctgggcgagcaccgcgcggttggcggggccgccgccacgaccgacggcgccgccgcggccatggaacagggtcaggtcgatgtcgtgcgactcagcccacttggcgatgcgctcctgagcggagtgcagggccagcgtggcggaggtcgggccggcgtccttcgaggagtcggagtagccgagcatgacctcgagcttgttgccggtggccttcagacgagcctgaacctcggggatcttgatcatttcctcgagcacgtccaccgagttctgcagatcctcaagctgctcgaacagcgggatcacgtcgatggtgggcacgtcctccgggtgggagaaggccaagcggttgagctcgtagacatccttgatgttctgggcactcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctgcaccaccttgagatcgttgaggaagtcgtcgcaggagtggtacatgaggtcggcatcgcgctcgatggtgtagtgcagacggtctgccatcaccagcatgaccgcgcggtgcatctccttggtggagatcagggcggccttgtcggtcagacgctcgctcatttccttctggtggctccagaggttcttgagctcggcgctcggcggcgtggtctcggcttccatcgtgaggttgcggccgacggtgcgggtggcttgctcaagggcggcgatcacgtgatcggagaacttgcgggccacggcgcggctcaccttggcggtgacgttcgggttgccgtcgcggtcggaaccgatccagctgcccgggtggaagaacgcggggcaagcgggctcgacgagaccggccttatcgcccaggacccagtcgtcgaagcgacggtaaaccttggggatggtgttgaacagcgtgttgtcgaagatgtcgagaattgtgtccgcttcctcaaccggggtcggcttcttcagcgcgattggagaagtgcggaacagggcgtcgatctcgttgtagagacggcgcaggcattccttcttatccgagccgccgaggcgcttgtactcctcaagcaattcggaaacgcggcgaatcttgccttccacggccttacgacgggcctcagtggggtgcgccgtgaagacggggtggaattcgagctggttgagcagttccttggccttggccgggccagtctcattgatgagctggtggtaagcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctttttacgttacgaagtccatatagtgcgccaagttgtccacctatagagaccgaatatcggacagcatatgagacactgtccgattcgcggaagatttaagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgagtaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattcggccgatctggccaagcgcctgcgcgaacgtgccaaggccgaggctgaggcggccaacggcagcgtggacgaggcgctggatcttgcgtcgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcggcgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgttcctggcgggcattctggcatcggcgtggcgttcatccgtgcgacgtggctggctaccgccgcacctcggctacccgcgcatctgcctgaccgtgccgtcgatcgtgatcatggtgcccggtctgtatatgtaccgtgccatgtggtacctcggcagcttccagaccatgaatgcgctggactgggcgttccgtgcgttcatggtgattatctgtctgccgatcggtttggcgatggcccgcgtggtgaccgacaagtcctggcgctacgacatctgaccgtcatcttggctcccctcaggtggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacgcatatcagcacatagttcctgccatggcggtagccgcttggcatcatgattggggaggggtcgcagttggccaacgatttctggattctgctggccatggtcatctattttgcggccatgctgtccatcggattcatctactccaaacgctccaactcctcctccaaggaatacttcgcgggcgggcgcggcgtggggccgtggctcacggccctgagcgccgaagcctccgacatgagcggatggctgctgatgggcctgccgggcctggcctacttcaccggcgcggccgacccgatgtggaccgccatcggcctggcgctcggcacctatctcaactggaagcttgtggcccggcgactgcgccgctactcggtagtggccggcgatgccatcaccattcctgacttcttcgccaagcgtttccatgacaagaagggcgtggtctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtccgtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgatcgtggccagggtcacgctggtggtcatgttcctgttcggcattctggtggcatacgaccagaactcgtcgatcttccaggtggtgtcttacgcgtgggccggacttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgccgtcggaataattggcagcagaggctcgaatttcagccgtttgtacagtggaatacggcgtagctttcggacatcgctaatttgctgggtagtttgccgcatcgtgagctggaccgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccctgtctaccgccctaatttttcggtggataaatgtggataagtcggtggataaactatgggtgttcatcgcagttgcaggccatcccgcaattacatggaacgtaggggtttgcaggcagccagcgggaatcgccgtcgacggcgcgattcaacttggacgaatctccatggcgttcatgcaaaggtggcatgatggccggtatgagtagcttggtgcgtattgtcaatgccggtgttccggggtctcaggaccgcgtggatgtggtgcttcgcgatggggttgttgcgtctgtcggccctgctggaacggtctcggcttcggacagcacgatgcagactaaggcgcatacgacatcgttggaatacgcgacgaatgccattgcttctggcagcgtctcaatcccaacgtcggccgccgcacccgccgacgaaaccaccatcgacgccgacggcctgtgggttattcccggcctgtgggactgccacacgcacttcacgcaatgggctaagacgctgggccgactggacctcatcaatgcccgttccgccgccgaagcgatggacatgttgcgccgtcatctggatgagcgccgcgccgccgacacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggccggcattaacggtttgcgcgtggacgccggtgtataccccgagcggttgcgagccgccattgacgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgcacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaacagaggtccgtcttgatagccgcgttgcacggaaaaacaagaaatccgcccctcgaagtgaagataggacacagcagacgtcgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgccccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgcgagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcattatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgaccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgccgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcgctggataacaagggcctgctgactgcggtcgattccaccgctcagggcatcgcgctgattcgcaaggcgttcgccgagctgcaggacgagaccgacaccacgttgcgtgcggtgaacgctccggccagcgtgtttctgccgcgcctcaacgccaatgattacgatctgatcgtggtggcgggcgacgccgagaactatgccgccacgttcgcccaggcctcccgtctgctgcgcacgcacggcgtgatcgtgttcaccgatgtgctggcgttggaggacggtcagggcggcgtgatcaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctcccctctccgaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctggaccaaggtcagcagctcgaacatctcatccagtgtgccgaagccgcccgggcatacgatcacgccggaggaatacttgatgaacatggttttccgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttgtagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcggatttcagcaggttggcggtggtgttgtccgagggaatcatctggccgcgtagaatcaccgggccgcgatgataggtgtcgcccagcggcgaggcgtcctccagatcgaccgggttcaccggtgtggccacagcctcagttgccgtctcagcctccaacgccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgcacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccaagctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttccgctccgggctgagtcgcgaagggcaaccttagcccaaccctgtgtggccgactcaaccgactcaaacgggccaatacaattggaaaagcctcggaagcatttcgctttcgaggcttactgtgcgccagacaggattcgaacctgcgacctgctgatccgtagtcagctgctctaacccgcggtctcaaccttggcaaggttgcgctttaccaactaagctatgtccgcatgtgttaccttcacgggcaacaggtgacaaagatacgccaatctcaggaaaaagccaagcccccgcgtgtcccaccggttttccaacgattatcgagcgccgaagtgaagttcccgaactacgccgacgtgccgtccttcatggaatcaggcacggtatgggcttcatccctcaacgcgcgataatggcggtatgacgcaacgacaactgatgcgggccacagtcgaaacgcccatcggccggatgatgatggcctccgacggcgagggacttaccgaactctgtcttgaagactggtggtgggccaccgatcaccaagccgttctcgattcgaatcgcgaatccgatagtgaacccgacgtattccgtataacccgcgaatggctgaccgcctatttcgccggcgaacgccccggctcggatcaggtgccgcctttgcatcccgccggcacgccattccaacatgaagtgtggaatctggtggccgaaatcccctatggcatgacggtaagttacggcgaactcgccgccgaattggccgaacgacgcggcggcggccgcatggccgcgcaggcggtcggaggcgcagtgaagcgcaatccggttaccatcatcgtgccctgccaccgcgtagtcggctcgggccgcgcgtttggcggctacggcggccgactcgacatcaaggccgagttgcttgaactcgagggcgtggatctggcgcgcttcgatctgccgaacctttgacgggcccagcggtccgcctcgtcaaaaaggattgagtggttaaccctcccgccggcgggagatggcgcgtagcgccggagggtggtcggctggctggcatcgcaaccctgctacccgacaattttcgacaagccgacgggaatccttccacgaattgttcgccgtcggtgcagtcttgctcgatcgcgccggccaaaactgtacaatccctacaatggaatgcatatggttaattgctgcgcgcagccgcacggccgcacgcgatcgcaagaccacatgacccaaggggatatgcaatatcaacggaagcaggaggtgcgtatgaccggcattatcgattacgcgcacaccgaaacgcgctccttcgccgacttgccgttcaatgaaatcgacgccttgatcatctccacgctcatctatgaggatgtggccagtatctgcccgacgttgatgctggatgagacgcggtcaggctcgttcgccgcacgcattcgcgctttcgagcccaagcatccactgatctggctgaggggtatctggcatcccgagcttgaatcggtaagccttgacgaggccaaccgcgagctgcatcgttcgccggaaacacatgccgacgacaagccgcacgaagcccaaatggtttcagtggtcaacccggacctgacccacgacctgttccaggccgcaggcgaaaacccccgctacgccaacgttcgcctgggcgcggtggtcgagcacatcaatcagggtgagcaaacccaattcgccgccgccaccttccaactgcccgacggccacaagcgccgaaagccgacctacaaaggcacgttggttatttccttccgcggcaccgatgattcgctcatcggatggaaggaagatttcaatatggctttccagtatccggtgccggcgcaacgttcagccagcgcctatctggatatggtggcgcgactgtgggaggggccgattattctggtcggccattccaagggaggcaatctggcgatttacgcggccatgaacgccgatcccaaggtgcgcaagcgcattcagcatgtctattcactggatggccccggtttcccgccggagattgtgaccagccccgcctaccgcaccatccagccgaaggtgacgaaaatcgtgccgagttcgtcgattgtgggcatgattttcgagaccccggagccttgccgcgtggtctcttccgattcggatggcatcatgcagcattccgccttcacctggctattggatggtgaccagttcatcaccgagccggatttgagttccagctcgcagttgtttaacgaggagctgaaccattggatcgccacgcttacgcccgaacagcgcgagcgtgcggtggatgcgctgttcaccgtgctgcacgccaacggcgccaccagcttcagcgaggtgatgagcaacttccccgcttcgattccggcgatgcttggcgcgtacgttgggctgacccccgcagaccggcgtcatttggttgaggccctggcgatactgttcaaggcgtccacggccaaacgcaagccgacgcccgccccggcttccgcaccaagttctgcgacctccaaagcaacagccgagatcccagcagaaactgcagcaggagcagatagcgcagctccggccagagccgatactgatgccgatgccggcaccacagcttcgccatcagcggaggacgcaactgaaatcgccgattagctcatagacatgtccacaaataatagttatactgcccaataagttattagacagcgtgaccatatcgcgctggtgcatcaggaggaagagatgccacgtccacgccatgattccgaggtgctgcccgccaaagaacgcctcgagaacgctttctgggaattgctcgccgaccgcgactatcgcaagatcaccgttaccgacgtggtgcgtgaggctggcgtgaaccgtaattcgttctactatcacttctccagcctgcccgaattggccgattcagccatcctgcatcaggtcgaatcgattccgatcaaccgcacccccgatccgaacggcaatcccgaggaacaatggcgagaccgcgtcaccgccacgctctccgatccagagcagcgtcagcgcctcgaccacctggccctgttggcaggcccgcacagcacgcttgaactgaccgaatcgctgcgcgacttctgccgtctgcaaatgctcagcacattgcaacgcgaccccaagaaccttgacctgaaaaccgatctcatggtcgagttcaccgtgggcggcatgctcgccgtgctgcaacgttggcccgaattgagcgacaccatcgaaatcaaagacctgcttaaagaagatgtggccgtgctggccatgggcatatacctggccatgagccaaaaggacatgcttaattactggaatcgcatcttcgtgcacaatgcgcaggattcgaccgcccccggcatgccggtcgccgccacgcatgccgcgccatccaccatctcatcgtcgaacggccccgtaggattccccgggtacaccgcttgaccgaaaaccagcgagtctggattgtttccgccgcacgaacctcgcgtgaggtttctcacaaggcgcaatcagcctctcatgctggcgtttccaacccacgcacaggaagatggaagcatgagcgaaacatcgaacaagacccgtctggaacatgactgcatcggccagatggaggtgccggcgaacgtctactggggtattcacacccagcgcgctatcggcaacttcccggtctccggcatcaccgatagccaacatcccgagctgattcgcgcctatgccacggtcaagcgcgcctgcgccatcgccaatgaggaattaggcctgatcgacccagccaaggccgaggccattcgcgccgcctgcctagaaattgaggccggcaaactggccgatcagttcccggtcgatgtgatgcagggcggtgccggcacctcgtcgaacatgaacatgaacgaggtgatcgccaaccgtgcgttggaaatcgccggccgccagcgcggcgattacacatacatccatccgaacgacgacgtcaacaagtcgcagtccacgaacgacacctacccggccgcctgcaaactcgcgcttatcgacgcgatcgggccgctcgccgagtccaccaagaaactcgccaaggccttccacgatctggccgacaaacatatcaatgacgtgacgattggccgcacgcagctgcaggacgccgtaccaatgacctatggtcaggaatttcatgcgtttgccacgctgttgaagtctgatttggctgcattcgatcgcgtggtgccgctgctggcccagctcaacctcggtgccaccgccatcggtaccggcatttgcgcggatctgcgattccgcaagtccgctatcaagcatctggcgcaaatcaccgggctgccggtcaccgccgcgcccgatccggtggccgccatgacggatatgggcgcgtacgtggccacgtcggctgccatcaagagcctcgccgtgcacctgaagaaggccgccgacgatttgcgactgctcaattccgggccgcgctgcggtttcaacgatctcaacgtgccggctcgccaggccggatcgtcgatcatgccggccaaagtgaaccctgtgatccccgaatgcgtcaaccagtgctgcttcacgattttcggcatggacgtgactgtgaactgggctgtggccgagggacagttgcagctgaacgccttcgacccggtgatggtgcatgagctgctgaccggcatggcgttgctgacgcacgccatggagacgttccgcgtcaactgcgtggaaggcatcgaaatcaatgctgacctggggcgttcatacgcccagtcctcaccgtcgatttccgccgcgctcaaccactacatcggctacgagcacgcggccgacatcgccgccgaagccgtacataccggccgtaccgtgcgcgaggcggccggcgaacgcaccgacctgcccgccgagcagttggacgagattctcgatccgattcgactggcccgcggcctcggccagacctgccgcgaacgccaggagtagcggaatcgaccgtaggccgattccgctttctgccaccccgtctccacgacttcaccagaaacgaccgatacagtaggcgtatgactgaatatgcagaagacatcgcacgctggtttcaggtgaacgccggcaaactcatctggctgaccattgtattggccatcgtatttgtggccgaccgcgtcatcagccgcgtgttgcgcaagattctggacaattctcagattcccagcgcctcgattttcgtgaacctcacgcgcgtgaccatctgggtcaccggcgcagcgatggtactgcagcccgtattcggcatcaatccgaccacacttatcaccgcccttggtgttggaggtgtggcgatctcgctgggtctgaaggatacaatcgccaacatcatcggcggcttcggcctgatgctgggccgcgtaatccaacccggcgatctggtgaccattcaaggcgtcacaggcaccgtgcacgacatcacctggcgtcagaccgtggtgcgcacccgttccggagacatgatggtcatccccaattcggtactcaatacggccgccctgaccaagctcacgccggtcagcgaaggcatggccacgcttgagttcacggccaaggcctccggcgacccgtctgcgatcagtcaggatattctcgaccgcgtaaccaaagccaccgccgacgtggcgctggagggtcagccgccattggtcaagttcaccggcttctccccttacggcatgaccggccaagtgcttgtgttcgcgcgcgagggtgtgctgccttccaccatcaaagatatggcggcgcgagccatcgccggttcgggcaccgaataccttgttgaagatggcggctcgtcaggcaatctgtgatatctcccggctcgcctctctgggtccggctatgacagtcatgcgaacagcatccaaccggtaagaatcacagtcaacagtaggtacgagataacgccgggattggcataggcggtgcgtattttaagccccgcaggcaactcctctggcgcaagatagaactcccagctcttgcgcttggtgataagcagcacgataccggcaatgcagaggcccaacatcactgtgccgtacaacatcatgatgcccatgccgcccatgttgccggtttcagccatacgcatgatttcggcctcgctgattgtgccgtcgaggatgcggggatcgatctgttgtatcaccaatggggcgagtactgacccgttcaggttgatcagcatgtgcatagccactgaataccgcagtcgggaggtgcgtgtgtatacatatccgaacatcagtcctaggccaaaggcgtagaagaactggaacacgttcatatggaatagcgcgaatgccaatgcggagaacatgattgcggtcttctctccgtaccggcgcaggcgggagataatctccttgcgaaaaatccattcttcgcaaaccggtgccaacaggcctatgaacaatgcgttcacccgccagtcgctgccaagaatcacgtcgttgatgcgattggtggcctgaccatcagtggctccggcagacaatatattgccaatcatattgcccaagaacattaccggaatgcacatgacgaaaatctgaatgaactcccccgccttcatggggtactgccgggtgcgaataaccggtacgcgagtgaaggccaacatactcagcggcatggccaccacatacagcggtccggaggaggcgagcagcacagcccaagcgggcacatcggtgccaagcagcgttcgtagtgcttcagtggccagaatattcagtccgatccagaacaccatcataatggcgagcgccgagccgattgtcgaaaaccggcgatgggccgtgaaccaccaatcgcgtggagattgttgcggctgctgcgattgctgaggtgcctgcggctgctgcgccggcggcattggttcgctcatacttatcccccatagttactggccgcaaacggaccgatcacacgtgcaatactcttcaagaatacggcacggcgtttcgattgcattgggaatgggggaggaaatcatcaatgggcaaggaatgatcaacgtcaatcattcccaatgccgagaaagtcccctactctgcaagattgctgtgggacggcacgcgataatcgcccaaaaatcgccgccgtcccacacacatcattgccgataagccattcgacgatcgtacagtcacaaaaacagaacagaaccgcacgatcatcgcaacgccattcagcaggcgagcgcggcgaccggacgcggggtgacaatcacgtcatcgcccaccgccagaccggccggcagctcgctggcgggcagctgcacggtggccttgagctgttcgcccttgttccagcgctggtattcgccggaggtgatgaccgtatccacgcgcaccaaggagccaaggaagtgaatgacctccacgcgggcgcgttcgccgacgtgcgaatcgctgctgccggccaaggccagcgtcaggttctccgggcgcacgagcacggccacggaatcgcccttggcggagccggcgagcagcggcacgcgctggccgaagaccacggcctcgtcgccattggatgcgccgggcaggcggttggtgagtccaatgaacgtggccacgtactcggtggcggggcgctggtacaggttctgcggggcggcgatctgctcgatcttgcccttgttcatcacaccgatgcggtcggccacggccagcgcctcttcctgatcgtgggtcacgaagacggtggtggtgccggtggtgagttggatgcggcgaatctggtcgcgcagctggacgcgcaccttggcgtcgagggcggagagcggctcgtcgagcagtagcacgcgcggcttgacggccagcgcgcgggccagggccacgcgctgttgctggccgccggacatctgctgcgtgtacttcttggcctgatcggcaagtcccacgagctccagctgttccatggcgatcttgcggcgttctgccttgcccatgccgcgcacttcgaggccgaattccacgttctccagggcggtcatgtgcgggaaaagcgagtaggcctggaacaccatggccatctcgcgcttgttgaccggcacgccggtgacgtcttggccgccgaccatgatgcggccgccctggatgtcttcgaggccggcgagcgagcgcagcgcggtggacttgccgcagccggagccgccgagcagcacgaccatttcgccgggcttgatgtccaggttgaagtcgtcgagcgcgtgaacggtggagccggggtagatcttgacgacgtcgcgcatctggatggagccgccgccgcgcttgacgctgtctttgagcagggccttggcggccttggtcacgtccttgccgcgcacgccttcgagggtggcggtgggatcgttcttgaaggcgtcctcggcggcagcggacgtggtggcgggtgccgaaacagaagccgcggcatcggcaccggcatggcgacgggtgaaaatcgaattgctgttcatcaggttacttaccttcccttgacttgcgcattgcgtcggagatcaggtcgagcgcaacgaggagcaccgcaccgaagagcagagccagcagcgacatggcggtggagatttgagaattggactggccgagctggtagagcgcgacctgcaggttcatacggccgagcagcgaggcgacggtgtattcgcccagcaccacggcgatggagataaaggatgccgagagaatcgactgccataggttcgggatgatcaccttgaagaacaccttgggccaggaggcaccgagcgagcgggatgcctcgaccagcgtcttgacgtcgatggagttaagccccacggcgatcgcgcggaaggcgaacggcatcacgagaatcacgtaggcaaagcacagccagattgggttggtgctcagcacgtcggcggacagccagcggtagatcgggcccaaacccaccaccagcacgatggccgggatggtcagcggcagcgtggccacccattcgatcgcgcgctccaaaaccttggagcgaatatgcacgatgaccatggtgggcaccagcagcaccagcatgatcaccacggtgaccgcgctcagggccagcgaggtgccgatgccctgccacagcacggtcaggtcggcacccagcgactcgccgttgccggtgaaaatcgcgatccacggcgcggccgaccagcggccggacagcgggtgacgcagggtgaagatgagcatggccagcagcggcacgaacaggaacgccagggtgacgaacaggatcacgaatttgatgatgctctgtttacgcgcacgagcggcgcgcagctgcggcggcttggttgcggaagtttcggtcattgccaacgtccggccctcttttccacggcgtggctcaacagcatgacgatggccacgacgatgatcattgcgaatgccagcacctgggcaaagccctgctggttggggtccagttcgttgcgcatggcaccttggatcataagcggcaccagaatcgaacgctgggagaacagggccgcagcggtcgcgtatgcggagaacgcggaggcgaacagcagcaggaacgcggagatgaagcggggtgccagaatcgggcaggccacgcgcgtccagtactggaacgtgttgccaccgagggattcgcatgcctcgcgccactgtggacggatcgaatcgaccgcgggcaggaagatgatgatcatcagcggaatctggaagtagcagtagatggtcaccaggcccggcaacgaactgagccagttcgggttcacggtgtagccggtcagtgtcttgataagcatggtgccgataccgttgatgccgatggtggcgatgaacgcgaacgcgagcatcacgccgccgaactgagcaagcacggaggagatggcggagaccatacgacgcagcaggccgttcggcttggcaccaatgaccagtgcgtaggaagcgagcgcgcccaccactgcgccgatcagagaggatgctaaagacaccagaatcgaggtgccgaatgcggcgatggtgttggcctcgaacatcttattgaagttcgcgagcgtgaagttgccgctgcgatcctggaatgcaccgacaatcacgatgacggtgggtgcgagcaggaagcaggcggtgtaggcgaagaacgggagcgtggtggcgagcgtgcccagctcctggcggtgcttggccatcgccgaggagagaggagaagcgggagtagcggacggacccgcagccttggcggcagcaggtccgttcgatgcaatgggtgcgattgcggcggtcatcggtctgtgcctcagttgccgatcgtcttgtcccagttgttctggagccactcggtgatgcgggtggagtcgtcgttggtgtaggagaccggctcgccttcgatggtgatggcgtccttcagagtggcctggtcgacggtgccgtcttccttcatggaatcgagcagcaccgggttggcgccgcccttgaaccacaggttctgggcgtcggcggtgtacaggtactcctcccacaggcgggcggcggccgggtgcggcgcgtccttgttgatggcctggttgtagtagctgacgacctgggccttcgggaaggtcttgtacttccagttcacgcccttgtccttgagctccttcttgtaggaggcctggttgtaggtccagtcgaagaccacgccggtctggccggagtcgatggtgccgttggtcacgtcgacggtggtcaggttgccggcttccttgagcttcttgaagtagtcaaggccgggctgcaggttgttgatgtcgccaccggcgagctggttggccatcaggtagccgttgaaggcggcgccagcctcggcgggcttgccgttgagggccacggtgccggcgaacttcgggtcgagcaggtcgtccagggagctgatgtcgccgtacttgtcggcgttccagcccacggacatgatgccggtgtagtcggcgtagtaggcgccgtcggcgtccttggcggtgtccgggatcttgtcccaggcctgcaccttgtacggggcgaagtagtcggtggaggtggcggcgatggcctggccgacatcgaagacgtcgggggcggcgtcggtgcccttgttggtcttggcggcgtcgagctcttccttggatgaggcgttcgggttgagctcggtgaccttgatctccgggtacttcttcttgaagctctcgatgacctcgccgtagttggaccagtcgtgcggaagggcgatgacgttcagcgcgccctcttccttggcggccttctcgaggtcttccatggtgccgaagtcggcgagggaggtggctttggcggacttttcgttcacggtgacggccttgccggtgctttcgccggtgccatcggaggaggcgttgctcgagccgcaggcggccatcgagaacgcgagcacggcggcgagggagccggccgcgatcttacgcaggttgttcataatgttccttttctcaacatcatccagacgacagtctggggagtcgggcttggtatgcgcggcattcgcgcggcccgtgaatccaagaaaagaaactatgcgcctaatctgtcctgacactggcgcgcaagtgaattgcgttcgccatttgctgtacgcctgttgaacttaggaaaacttggcatgaattactgacaggtatgggcgatgtgtcaatagcggaaccggcctgcggccgattccgcaccacacttacctcagcacgccctcaatcaatcgcgtgatgagttcggtgtagctcactccggtggcatcccaagccttgggatacatggaaatcggcgtgaagccgggcatggtgttgatttcgttgaccatcaccgtgccatcaggcgtcacgaaggtgtccacacggctcaagccggcaccatccacggccttgaacgcgcgacgggccacgtcacgcacgtcctcaagcacgctgaccggcagattggcaggcacttccacgtggctggcggaggcatccatgtacttggagtcgaaatcgtagaactggtcgtcgttctgatgatcgagcacgatttcgccgggccagctggcctcgggctcgtcaccggccttcgggcacagcacggcacattcgatttcgcgaccatcaatcccctgttcgacgagcaccttccagtcgtgctcgccggcggtggcgatggcggcggccagacgatcctgctgggtctcgcggtcatcggctttctcgactttggtcacaccgaagctggagcctgcgcgcgaaggcttgacaaacagcggataagtaagaccggcgtcctcgatctcggcaagcacatcggcggcggtgaagttgcgcgcatcgaccgtcacaccgggcgcggtgggaatgccggcggcatccagtaccaccttggtgtaatgcttatccatgcaggcggcggaagcaaacactccgcaccccacgtacggcacacccatcatttccagcaggccttgaaccgtaccatcctcgccataggggccgtgcagcaccggcagtaccgcgtccacatggccaagggaggtcagcacatggtgcatttccgggtcggacatgctgacgaagctggtgccgaagccggaatcggcggaattgatgtggctgggctcgccgatgaagaaaccgtcctgtccgcgagaggggtcaagcatcaccgggcgcgattccggggtgatctttacggtcggcagctcgccgccgtccaagttccagccacgcggatcttcgccattgatgatccacttgccgtccttggtgatgccgaccggaatcggctcgaaccgttcagtgtccatggcccccagcacaccggcagtggagatgcaggaaatcgaatgctcgtctgcacgcccaccatagagcaccacaacacgcttcttggccataaccatccttttgttgaaactacaaccgttttcaagcctatgctttgcaccgccaaccggaccgaaccgcgctcggaacgccgcgcacaagagacgcacaccagtctactcgtgcacgtcaacgacgtatacgccatgcgactttgcacgtacaacgtatacgccacgtatacgtcgcttctctcgttattcgccggtaacctcgtgaccgaacagtccggcaagcatctccgagcaggaaatgccttcgttcagcacgcggctcatctgatacgccaacggggtcggcacatcaagctgatcgccaagagccaccaccgcatccgtggtgggcacgccttcggccacaccgttgctgaccttggtggcctcttcgaccgtcaatcccttgccgagattcgcgccgaacgtatagttacgagacagcgaagagccacaggtggcgatgagatcgcccacaccggccaagccgaagaaggtcttgggatcggcgccagcggctacgcccagcgcggtcagttcggccagtccacgagtttcgatcatggctgcggtgttctcaccgtagccggcaccacgggccatgcccacggccagcgcggtcacgttcttcaggctgccgcacatttccaggccgatgacgtcggtggtcacgaacggcttgaaataggaggtggtgcatgcctcggccaccttcgtggcattatcgaggttcgtgcaagccaccacggtggcggcgggatgacgatcggcgatttccttggacaggttcggtccggaaatggcggcgaaccggtcggccggcaagtcaagggattcgcggacgacttcgtccatacgcttgttggtgccacgctcgatgcccttcatcaggctgacgacgatggcgtgatcgggaatcagtcccttgaattcgacgagtgccactcgcgcgaactgcgcggcgatggccacgactacgatgtccgcgttcttgacggcttcggcgcgatccccagtggcggtcatgttgtccggcaacttttcgacggacggcaggcgcacggcgttgtggtggtgatcgcgaatgccctcgacaatctgctgctccttggcccacatggtcaccgtgttgcctgcgtccgccagcacttggccgaaagcagtaccccatgctcctgcaccgagaaccgttatatttttacccatatcaaattcctaccttcgcttgtcgcgcaacttcatcggcacaatcttgtgccatgctactcgcctaggctccccgtacgggaaccggtgcggctacttctcagccgggaacgggccgccggcttcaggccaaggcttacgactcatactgcggtagtcccagtagccttcagcggggaactgctcgccacgaatttcctccagtactgtgttcatgcgtttgagcacgcgccacatcagctcgttcacggcctcggcaggcggctcttcaccccatgagtccatgtcggcaagcagatcggagtaatcgagcgcatggtcatagcacatcaccacgtttttgcgcggccatggccaccagtggttgatggaggcggcaccccacgtcaccgccgggtacagcggcacctgatgccccagtctgcgcgaggattcaagggcgatatatcccacgccctccttaatgctcatcacccactttttcgggtcgcgggtcacggtgccttccggccagaccgtcagcgggcggccggacgtcagaatatcaatcgaggtctcttcgatctgcttggccttgcccgaatgacgctgcaccggctgcatgccgaccaactggaaccacttgccgatcaatggccacttcgccatctcggccttggccatgtaacgggggcggcggcccatgtggaacaggctcatcattggcacgaacacatcaaacatggtgacatgactggcggcggtgatgaacggtccggtttccggcacctgttccaagccccaggccttggtcttgcagctggcgcggaacacaatggacacccctcccagcagtcgtttggtggccttgggattctgggcgttgatttccggctgattgggcgtgcgggggccggtcgggtaatactgtgtcgagtccacaagcgtgtggcgggcggccagacgcttgacctgctcatcactcagcgggcttacggccgaacgcggcgacggttttcctttggatgccatggtctctattgtggcacggaccaccgcccaacgattccagcgcaacgttcccgggaacgtgccgcggaaccacacctcgcacccccgcccagcgaaacattccccggaatgcgtcgcacaatacgcggcagcccgtctgcacacaccatgcgcgcagacgggccgccggggaaacgttcgaatcactccaccgcgatggcgtcgatctccacgagcgcacccttgggaatcatgttgttgccaaaggccacgcgggcgggcttgacggagccgatgaacgcctcagcgtaacgtgcgtccacttccttgaagtcctcgacgttcttcaggtagatggtggcacggcacacatgctcaatgccggtaccggcagtgtcgagaatgtgcttaatattcttcagcgcctgtgcagcctgctctccagcggtctcgcccgccagttcgccggtggccggatcaatgcccagctggccggatacgaacacgaagccattggccttcaccgcctggctgtatgcgcccagcgcggccggcgcctcggaagtggctacggcttccatcttttcgctcatattgtgctccttctcatcttgggggcgcccacctgctgcggccggcgccggtacacatcaccaccggctacgaccaatcgcacgatcagcaacgattggcaatgccgattacgtagcagtctactgagcaaagtcgcgtttagcgcgcatgatgctcggcatacggccatcaacagactattccttgctattccagacgattccagacgattccagacgattcggctaccgttctcgccaaaccggacggtttttccacgacccaagcgagccggcatcaccggccttgccattgccgacaccagcaccagccttgcacgcgccgaatatgcaaaaggcttccggcggttagccgaaagccatgctggtgggcttgatggggatcgaacccacgaccttctgttccggagacagacgctctatccactgagctacaaacccgagcaacttctttactgtacaccacatcacgttgcatgcggcacatacgtcgccaaaataacgagaaaatcgccattatcggctctacaatggggttatgtcggaacctacagatgacttcgaatacgaacgccgcttcttctgccgcgaactgccggcggaatacgacgacggcgacgccccgaccctcatcattcagagctactacgtgcatgccgacaattacgccttgcgcgtgcgcctggtctcgcgcaaggttcacgtcgacatgacgcccgacgtaaatccggtggccgtgctggacgaataccgcgaccggttctcggaagcatatgtcaccgtcaaaggtccgtccgtgggcggcacgcgctacgaagtcgagcgcgaaatcgatacgcgtatcgcggccgaactcatcaagcgcggcggctcggtaatcatcaagaaccggtattccgtgtggattgaggaagacggctggagcgtggatgtgttcggcgggccgaatgcgccgctcatcgtagccgaggccgaacgatccgggccggttaccaatctgacgattccgaaattctgcatcaccgaaatcaccgatcaggcgcgattcaataacgatggtctcgccaaccgtccgttctgtaagtgggcggatgatttcaaggaggagctggcgctggaggggccaaggttccagcagtatttcgggaagaatcggatggtttagggggggggagcaatcgagtacgctcgtgagctcccctcagtcatctacgacgacagcccctctcaaagaggggagccaaaaccacttagtacatgagggtggctaggcgacgacgggcgcgggtcagacgcgggtcggtgggttcggggatggcgaagtattcgagcagacgcttgcgaacctgctcgatatcggccttgtgcccggcggccaaaaagtccagcaaacggtcgaaagcgtcttgaatctggccaccaatcatgtcgatatcagccacggccaactgcgcttccacatcgtccggcgctgcggcggcagcggcacgtacgtcacgtacatcagcggccccggagcgggccagcaacagcgccttcgcacgttcgcgggcagccagtgcatcggacgggtcggatccgagcacgcgctcgtattcggcggcggcaccggcgtaatcgccctcctcggccaaacgatgggcttcggcatgctccggcggcacctgctcagcacccgcgacggcaccggtggcaccagcgctcttggcggcatcggaatcaggatcacccgagtacggcgcggtaccgttcacaccagactgcgcggcggcctcaataatcttcggaatcacctcgtcagtaagttgcttgagctcgtcgtcacccggaaggccctgcaacagcggcatcggacggccggcaatcaacgcgaacagtgcgggcacgccctgcacctgcagcgcttgggcaatcgagggattggacgagatatcgatacgggagagctgaatctggccgttcagggcgttcaccgcgtcgcccagtgcacgggccatcgggaacaggcggtcatcggtcggcacccacagaagcagcaggatcgggaaggtcgcagaagtctgcaccattgcctggaaggtgttttcggtggtgtcgatcacgtacccaccagcggcaggcgcgccgcccgcttgtccgggctcggccttgacctgatgcttcagcgcctccaaatcgacggcgcccgccaatgagactcccggattgaactgctgctctgccataatgcctcccgattccacgcgattcgcgtacaacaacaatcacatttgctgacattgattgtaatgccgattcccaccacgtagggattcttccactacgcggtgaaattcccaccacgtagcaaaacgcccaccacgatgtgactcaaaacggcaccattgtgcgaaaggtaaaacttaccgacatcgtggtggatgaatcatatcgtggtggggcgttaaccgcgcggtgggcggcggcaacaactacagcgcttcgacctttaccggctgacggtcggcacccacggcggtgatttgctcaccggaacttgccaacggaatgtacaaggccaccacgttcacatacgtgaccttcatggtgctggtgtacttgtcgctattgaacagcgccttctcgtcgtcggaagccggccgcgattcgcggccatcccctgccttgcgagtccattcgccgttaatacggccaaccaccagatcaccggcaccgtctgcagcacgcatcacccacatctgttcaggcacagcggtgaatttttgctcctgcgtaccgttgttgcgttgcataccttcctgcaccttggccgtggtattggccagttcctggcgcagcaaatcgtctgcgaacttggaagcgtattggctcttggagccgttctgcagcacatcggcgtattgggccaaggcatcggcgggagcggccaccagcttctcatcctttgcggtgcccatctgcgagccaatagtcggaatctcgaacttcggcagcttggcgccctcaaacagtcgagccatagccatcagcttgtaattctgctgggcggattcctgatcgaagaccagcaaacgcttggactgctgatcttcggtggtggtcgtgatggtgaacaccgagcgaggccatccgtcgtccgtaggaatcaccgtctgggcgatgtccttgggaatggtcgcatattcggacataccgccgccacgctgattgatcgtggtctggctgatgcgaatgtccagctggggcccgcccataacggtcgcatacccatcgggattcttggcctgatcggcttcatcgatcgtcttgagaatcttcagacgaatcttcttctcctgcgcctcggtcaaatccggcgcaaccttggtggaggtatcagcagccggcgtcggcagttggccttcacaggcggtcaacggcacgaccaacgccatgcaggcgagggcggacacacacagtttgttccatcgcttgttcatcagctttcctcctgtccgtcatcggccgagtcgtctccggtattgacctcttgggccaagcgggagaagtaggcctgcagttcgtcaggggtgattaccgaagtcgattcgttatcgccggcgctgaggccgggctcagcgccgctttcggcaccggtctgctggtcggcgaccaggttacgcgaacttgggtcgatgataaccggtgtttcggtggcttcagattgcgaggattgcgaggacgcacggcccgaacgccgatgtgtggcgtgacggcgacgattacgtcgacttgcaccatccggcttcccggacactgcgatgctggcgggtgcctcttcctcgattacggcgcttgccatgccttccaccatgcgcttgcggcgcttatgcggcggcatggcgaacacggaggcgcacagtacggccagcacggccagcaatccgccggacagatagaacggcatcgcaaagtccggcacttcggagcgcacccagtgcagctgcaccttggcgttggtgacattttcgcccaaatccacaatggctaccgtcgaggcgccggtcttcttgctcttcagcgaaacggacccagtgccgcatttcacggcagtccacatatcggaatccttgaacgacaccgcgtcatcggcactggtaggcgctccctgactcgtgctgcttcccttctgggtgctcagctcgctccatgatgccaatccggtgatgcgggtataggacttctcggacgcgacccatccggcaacatccttggacgaacccaacgccacgcacgcctcgtcctgagaggatcccgagtccacggttatcgtggcattctgatccaacaaggtcagcacattcggatcagtgacgacataccgggagccgctcatggttgcggaagcggtgatttcagtggagggcttccacatcgtggcattcatgtaccccaacaccacagccgccacggccaatagtccgaagataggcgtcaccactccacgcatgattttggcatgacgggatggacgcttggcgcccttatccggtcttgtagtctgttcttcagcactcataactcaaccattctacaatcttcacctgtttattacctaggagcgcagaaaatcaaggtttaccagtagggtgatgtgtcatgcgtaagtctgttaagtctatgttatctcccctcggcaaggccgttgcccttgcctgctcgctggcgatgtgcgtgtcgctggctgcctgctccagttcgagctcggactcgaaatcctcttcttccgattcctcttcatcttccgactcttctgacaagaagggccaaattgccggcgtgaccgccaagggcaagctcggcgagaagccgaccatctcctttaatacgccgatgaccgtgtccgacggctcttatgtggtgctgcagaagggcgatggcgacgtgatcgaggagggcgaccgcgtctgcgcccaaggcatcgcgctcaacgttaaagacggaaccgagctcatggacacctggaccaagaacacgccggattgctcgctgaaggtggattccaagaccctctcctcgacctactacaaccagatcaagggtgccaagatcaacaccacgattggctttggcgtcaacgctcaggattcgtccgggtactcttacattctggcgatgacgtttgtgtccaagtccaaggacttggagaaggccactggcgaggaagtcaaggatgtgccggccaatctgccgaaggtgacgcgagccaaaaacggcgagccgtccatcgacatgaacggtcagggttcggttgattcgctgatctcgcagacgctgatcaagggtaacggcgccaagctgaccgacaagaacaccgtggtggtcaagtacaccggttggcttacgaatggcaagcagttcgattcgtcctgggatcgcgattccacaatcgacgccgatctgttcagcgattccagcggccagcatcaggttatcgagggctggcagaagggtctggtcggccagaccgtcggctctcaggttctgctggtgattccgccggatcaggcctatggagataaggagcaaggtccgattcccgccaactccacgttggtcttcgtaatcgatattctcgccgcgtactaaaagatatagcaggggctccctctgatgagggagcccctgctatatctagaacagcctgagactgtcgtcctcggtgcctttcatatcgtcgtaatcgaggatgaggcaggtgaagccgcggtctttggccaagacctgggcttgcggcgtgatggtttgtgcggcgaagatgccgtgcaccggggccagcagcggatctcgattgagcagttcgcagtagcgagtcagctgctcgacgccatcaatgccgccgtgacgtttgatttccacagccacatgctcgccctcggcattcacggccataatatccactgggccaatggcggtcgggtattcgcgacgcaccagcttggctcccttgccgatacgctcgatttgctcggccagatagcgctgcagatggtcttccacgccatccttgatgagacccggatcttcgcccagatcataggtttggtcggaatagatatgctgcagcgtcacttcaagaatgtccgaacccttgtcggcgctgacacgtagcaccttttccggctcaccagcggcgacactttccggggaatgcgtcgcagaatcaccatccacagccccaccagcgacactttcccgggaatgttgcgcggatttggcggctgggtcgatctcacgaatcgtgcagggcgcggtcatccagttcagcggcttgtaggagcccaattcggagaaaatcaacaggctggaatcggccttgatcagcaatacgcgcttggccaggggcagtgaggcgttgaggcggcccgaatactcggacgaacagtcggcaacaataactcgcataggccaccactgtagcgcaacacatggcatacatagcaaaaggggctctctggaaaaccagagagccccttaaggagttggttcaggtcactcggcggtgccggagtactggacgtcgtggccgcgctcgaccgccacggtgagtttgttcgagtcgaaggaaatgaatccgtcggtcacctcgaacatgtggcgatcgccatcgggctcaaccacggtgagcgtaccctgcttgatcaccgtgagcacaggctcatggtcgggcaggatgcccatgccgccctcagaggcgggaatggtcacgctcgtcgcctcgccgtgccacacagggtggtcagcggcgacgatgttgaccttcatcgtggttttttccgcagccatcacgcacccagttccttctgcatgttgtgccacttctcttcgaggtcgtcgatgccgccgatgccggagaacgcctgctccgggacgtcgtcgtacacgccgtcgcagatgcgggtgaaggcttcgatggtctcgtcggccggcacgtaggagccggggcgaccggtgaacttctcagccacatagaagttctggccgaggaactgctcgatcttacgagcacggttcacggtggtcttgtcctcttcgccgagctcgtcgataccgatcagggcgatgatgtcctgcagctccttgttacgctgcagaatcgccttgacgcggttggcgcagtcgtagtgagcctggcccacgtaacgcggatcgaggattcgcgaggtggagctcagcgggtccacagccgggtagatacccttggaggcaatgtcacgagaaagctcggtggttgcatccaagtgggcgaaggtcgtggccggggccgggtcggtgtaatcatcggccggcacgtaaatggcctgcaacgaggtgatcgagtgaccacgggtcgaggtgatgcgctcctggagggaacccatctcatcggccaggttcggctggtaccccacggcggaaggcatacgacccagcagggtggacacctcggaaccggcctgggtgaagcggaagatgttgtcgatgaacagcagcacgtcctggttctgcacgtcacggaagtactctgccatggtcagtgcggtcagcgggacacgcagacgggtacccggctgctcatccatctggccgaagaccagtgcggtcttctcaagcacgccggcctcggccatttcgccgatcagatcgttaccctcacgggtacgctcgccgacgccagcgaacacggacacaccaccgtggttctgggccacgcgctgaatcatttcctgaatcagcacggtcttgcccacacctgcaccaccgaacagaccgatcttgccgccctgcacgtacggggtcagcagatcgatgaccttgatgcccgtttcgaacatctgggtcttggactccagctgatcgaaggccggcgggttgcggtggataggccaacgctcggagacggtgatggtctcatccggcttcttgttgaggatgttaccggacacgtcgaagacgtggcccttggtcacgtcgccgaccggcacggagatcggggcgccggtgtcggagacggaggcaccacgaaccaggccgtcggtgggcttcagagcgacgcaacggaccgtggaatcaccgaggtgctgttcgacctcgagggtgatctcggtctccttcgcctcgccttcttccttggcgctggtgttgacgatcgttactttcagggcgttgtagatgtcgggcagatgacccaccgggaattcaacgtcgataaccgagccctggacgcgggtgacgcgaccgttggtaggctcggccgcagtggtctggttgtcagccatatgcgttcctactcttccttcttggtcagcgcgtcagcgctgccgatgatttcggtaagttcctgggtgatcgaggcctggcgggaagcgttgagcttgcgcgtaaggtcgtcgatcaggtttcgtgcgttgtcggttgccgtgtgcatggcgttctggcggcttgcggtttccgacgcggccgcggtcagcaggcactcgtggatacgggactgaatgtacttcggcagaatcgcatccagtaccttttcgaggctgggctcgaaagtgtacagcggagcgacatccgcagtagccggtgcctcttcatcaggatcgggcaccttggtctcgtttttcacgatttcgaccggcagcatgcgcagcacgcgcaccttctgcaccaccatgttgatgaactcggtgtagacgatgtagagttcggaaactccacccttctcagccggcttcatgtaggcgtccatcaaggtgttggagatcgtttcagcaatttccacgccgggctggtcggtgtcgccttcccacgtcgccgcgatgtcacgattacggtacttgtagtacgtcgaaccgcgacgcccgtacacgaacagctccggctgcttgcctgccgcatcgaggcgggacagcagcgactccgtttcacggataatcgaagaggtgtacgggccggccataccacgatccgaggtgagggcgagaacagccacgcgcgggttcttctcgtccttcaccgcgatcggatgcgtgatatgggtgtgggccaccaacgcttgcacggcatcgaaaatcgcatcggtgtacggcttcgcgttcagggccacatcacgggccttggcgatatgcgaagacgcgatcatctcctgagcgttgaagatcttcgccaacgactcggtggagcggatgcgtgatttcaatgcgagttgcgagcccatggcttacttttctcccgccacgatcttttcctgatcgaccggcgcggccttgtcaacgtccggcttcttctcgaccagcggcttgccggcggaagagacgaacgtcgaacggaactcgtccacggccttatcgagggcagcctcggtgtcggcggtgaattcctcggtctcgcgaatggtcttgaggatatcggtgttgtggtcgatgtagtccagcagtccctgctcgaacggaaggacgtccttcaggtcgaggtcgtcgagcttgccgtgggtgccggtccatacggacacgacttcctgttccggcgagtacgggtggaactgcggctgcttcaacagctcggtcaggtgggcaccacgggtcagctgggccttggaagccgcatccagatcggaggcgaacatggcgaaggattccagcgaacggtactgtgccagggagatcttcagcgtaccggagaccttcttcagagccttggtctgtgcggcgccaccgactcgagagacggagataccgacgtccacggcggggcgctggttggcgttgaacagatcggactgcaggaagatctggccgtcagtgatggagatcacgttggtcgggatgtaggcggacacatcgttcgccttggtctcgacgatcggcagacccgtcatcgaaccgccgcccagatcatcggagaccttggcgcaacgttcgagcaggcgggagtgcaggtagaacacatcacccgggtaggcttcacgccccggcgggcggcgcagcagcagggaaatcgaacgataggcctctgcctgcttggacaagtcatcgaagacgatgagcacatgcttgccgttgtacatccagtgctggccgatggccgagccggtgtacggggcgatgtacttgaagccagcggaatcggctgccggggaggccacgatggtggtgtactccatggcgccggcgtcttccaggctctgcttcaccgaggcgatggtggagcccttctggccgatggccacgtagatgcagcggacctgcttcttcgggtcgccggattcccagttggccttctggttgatgatggtatcgatcgcgatggcggtcttaccggtctggcggtcgccgatgatgagctggcgctggccgcggccgatcggggtcatcgcgtcgatggccttgaggccggtggacagcggctcgtcgaccgggtggcggtgcatcacgtcgggggcctgggcttcgaggatacgacgaccctcaatgccctggatctcgccgaggccgtcaagcggcttgcccagcgggtccacgacgcggccgagatagccgtcgccgacgggcacggaaagcacttcgccggtgcgtcgcacttcctggccttcctcaattccagcgaaatcgccgaggatcaccacgccgatctcacgggcgtcaaggttgaacgccaggccgagcgtgccgtcttcgaacgtcagcagctcattggccatgcaaccaggcaatcccgtcacgtgtgcaatgccgtcaccggccgtggcgacatagcccacttcctgggtgggggtgtcgctcggcttgtacgacgacacgaagtcgtcgagggccttgcgaatcgaggcgggatcgatggtcagttctgccatgatcactccttctattggttattgttcagtcaagtctttgcttgtgtgtggtgttggacggattggctcggccggtcaggccggagtcgcctccgtctgcaccttgcgatgcaagttctgcagctgtgcgaccacggtgttgtccgtgacttcgtcgcccacctggatgcgcatgccacccagcacggtcgggtcgaccaccgagttgatgtgcacctgacggcccaccttggcggagtagacctcgaccagtcgcttgatctgctccttcttcagcggggtggcggtggtcacggtgaccatcgactcgcccatgtggcgggagaacttgttgatcagccactggatggtctccaagtagcggcggcggcgcaggttgcaagtggcgtgttcggcgagcctcatggtgaccttgttcagggtcttgccagagaacacctcgcggaacagcttcacacgggcctcgctggtggcctggtagtcgtacagcttggcgcgtacgaccggcaggttcagcagtgcggaatgcagctcggacagctcgatggatacctgcagcgtggcgtcagtggcgtccgcgtagtacatcatggcgtccacgccgaagtcttccactgcgttggcgatgtcgcgcgcacggctccaacggcgggagaccaagtcagtcatgatctccatggtcatcggatgcgcgttgtcaccgagcagttccttcaggacggccaccttgtcggcaaccgggcgggacgggtcggtcagtgcgcgctccagctgaatgctgtcatcgagcaccttggtgatcgtgaacagttcgttgccgatccgccacgcgtcctcacgggtgtcgcgcagtttcggggccagcgaatcacgcgactcgcggtctgcaatacgtgatgcctctcctcgcatggtcacctccctttctggttacggatggtcacggtcacttcttggcgcccaggtcgtcgatcatcgaatcgatcatcgaggactgcacgtcgttgtcttccagcttggcaccgaggatcttgccggccagggcggtggcaagtgcgccgacctcgcccttgagcgagacgatggcctgctggtgctgggattcgatcgagcgctgtgcggatgcggtgatctgggccgcatcggactcggcgcgggaacgagcgtcggcgatgatgtgggacgcttccgcacgggcgtcgtcgcgaatcttggcggcgtccacacgggcggtgctcagctgggcctcatacttggccttggcctcgtcggcgtccttcctagcctgctccgccttggcgatgttgccctgaatcttggcggcgcgctcgtcgaagatcgcattgaacttcggcatgaagaacttgtagaagaacaccgcaacgatgacaagaatgatcagcgaccatacgatgtcataaacctcaggaatgaacaggtcaatcccgcttgctgcttgtgtcatcaagccctcctttcagtgatggacataatcggttttcgtctgttgatctgcgcagatcagatgatcagggcggcgacgaagccgatcagtgccagcacctcgaccagagccaggccgatgaacatgatggtctggatcttgccggacatctcaggctgacgagcggtggattccatggccttgccgaagaggatgcccagaccaatgccagggccaagagtaccgataccgtaaccgatgacggacaggttgccggcgacctctgcgagggtgatgatatccattgtgtttcctttctaacgtacttggcgacgttataaatcttggggtttggtcggtctgcgattttcccagaccggggaccggaagcggcgggttagtcgcccgtcactcttccgggaagctcaggttgatgtacacggtggaaagaatcgcgaagacgtaggcttgcaggaaggcgacgaacgcctcgaagcaggtcatggcgaaaccaccggcgaaccacagcgcacccaccgggatgccctgcagcttgttgaccgcgtcaaccatccagaactgtgcgaacgccaggcaggtggcgaccataaggtggccggaaaccatgttggcgaacagacggatggtcagggaggccgggcggatgatcaacagctcaagcaggttgatcggagccagcaggaaatagaccggccacggcacaccgggggtgaacagctcgtggcgcagatagtggccgaggccctgcgagcggatggcggcgatccagtactggatcagtgtccagacagcgaacacgagcggcatgaccaccgtggcgttggccgccatgttcatacctggaatgatgccgcacaggttgaaaatgaagatcgtgaagaacagggtggtgatcatcggcacgtagcgcttgccacgggcctcacccatcacgtcatacacgaccttgtcgcgcacgaagtcgagaccgtactcgactacgccctgccaacggccggggatgagcttggcgcgctttgcggtcacgccgagcaccaccaacagcacgatggttgccacgatacgaatcaaaataatgcggttgatggcaaacggagttccctggaacagaatctccgggggaaggaagtcatcaaccgagggcagatgagcgcctgcctcgtcagccaacagcaatcctgcgctgagcgaaccgaccatatcacgcctcctgcttcttcaatgtcaggtgtcagtttaaacccaccgggcaggcaaatgtgacgtgctcgttactttcgtcttttttgtctcctcggtgtggagtctgccgggcatggacacggagtctgcgctgggcattcggctccgaatgactgaagagtgattatttgcctgcgtctagacaatgtcaatattataccggcgagtctcctgaaatccctactgctgcaaggttttcccgggcgtttcgcgaacgttgtgcactattggtcgcattacgcggatgtgtggcattacgttcatcaagccgtccacatcgtggacgaacaaccgtccacgctacgaacgcaacctccaacagtagctccctctgatgggccgagccgtgaaggagaagcaaaggagctccccgtcgaggggagctgtcgtcgtaggcgactgaggggagatcgtaggctcagccctgaatcaccccatacccgtcatgcacaaacggcttgaaatcatcctggcgcggcccgcccggctcatgccgaatcgaacgatcagtaccgagcttcttctcagccctgagctgcggcacctcggtcaggtcatacggcgtggtctggtacacccagttgagccagttgcgccacagcagattggcgtgggcgcgccaggcgaacaacggttccagcttcggatcgtcatgcgggaagtagttcttcgggaagggcacgttggtcatgcccttggccatatcgcgctcgtattcttcggcgagcgtgtacttgccgtactcccaatggccgagcgcgaacacttcggagaagtcacgcgtggcgatcaggcccgggccggactgcggcccccaagtcaagatctgaaggtcatggttggcacgtacctcgttttcgttcacgccggcgaggcgggagtgcggctgcagatcaatctcgtcgaagccattggtcaggaagcagtattcatcctgcaggtactgcgggaatacgccgaaaatcttctcggggtaatccaccttgtggatgccgtagcggtagtacagtgcgcccatcgcaccccagcacaggtatatggtggagaacacatgggtggaggcccagtcgagaatcgtcttgaactcgtcccagtagtccacatcttcgaacggcatatgctctacaggcgcgccggtgaccacaaaaccgtcgtaatagttgtctttgaacgcatcgaggttttcgtagaacttgacgagatgatcggcggaaacgtgcgtggcctcatgcgtggaggtcttcatgaagtcgatttcgacctgcagcggcgacttggaaatcagacgcagcagctgtgtttcagtctcgattttcttaggcatcaagttcaggatcaccagtttgagcgggcggacgcgctgacgctccgcctcgggcttctccagagcgaagatgcgctccgaatcgaggatatctctggccggcaggccactggggatcttgataggcatgttcctattatgtcaatattcgggataacggttcagggcattcctataacggccatttatggcgcgttattaccccgactccggctccgccccaaacccctcgctgcgtgagccaattcacgttttaaaaccgcgggaagatgacgcgacacgccgatgttgactttctggaatctgcacctattgtagatagagttgtctgagagacaagccgacgcggggtggagcagctcggtagctcgctgggctcataacccagaggtccatggttcaaatccatgccccgctaccaacgaaacgctaggaattacaacgattcctagcgttttttcattttctgactagctcggcattgctgcctgttctggacaaaatctggacaaactcaccaagcacggccaacaccgatcagcgggaatcaggcagaccggtgcaccctctctattcgtttcttaaactctttgcttccttcatatagaacgcaccgaattaaatcatctttaacccccagtctcttcagagagtcatacactggagtaatcgtatagtcgtattccttgagaaaattatttgtcatataaagcttaaagagataaacgtccgtcggcctatcagcatctctaccgatatcacaaagagcaagggcaaaagacagatagttctctgtctgcaaaaactcacgcatgagatcggaatggaagccctgaagcgcttcactatcttgatggctaagtaaatatccgacaaactcgtattcgggtttgtttttacgctcggtgaataacttctcttgagcgtctgccgccctcataggcccttcggccatcaagaagccattctcagacacggcatcgttcattgttttttcataactcttcaccatgcgatccagctttttcgtatcagtttcaagcaccctcgcaatcgccgcgttggaatttttcttcattcgcgcaagtatcacttgttgcgccagctgaaacttaagagaagcaaaaaaacaacgaagactaaacagctttgccaagaatataatttttaaactatcttcttcagcagtcggcaaattattgatctccaaaaggggaaaacaaactattttataaattttatgatcataaaaagtagttaccttacccctaagaatcttattgcatttatctaacgcttctgaatatgaagcaatctttttctcaagttttgttttcctgtcttgcttttcatcatatctattaccgacactgtcatcatctagacttgttaagtaattatccgaaattgcccgaagtgttaaatcatgctcctttcgctcgtttagtaatttatatagtttttctgcatccaattcttcgattgctctattgcacttatccattaaaaaacattgatcatcaataagagcgatggcaaactcaggcttcattctttcgggataatcaccaaaaaagcgcgaaaggacattacgaagctcccgaaattttatctgcttctgaaccggcatccccatcaatgctgtctcatcgccatttacgtagcgctcaaaaacctgctgattgacacccatcgcccctcccaagagttcaactaacggcattttccccaaaaaatacgattttcgcaacacgagctggaccaatgcggcaaagtgtgaaacaagccaacacaaaacgaaaggaggtgattcactatggatgacagcacgcccattctgcatgccgaggtcgttcaggctgtcagcaaagccggcaagccttatgaatgcatcgaaatttctctcggtgaaatttccgtaggcagagttttcccaagccctctggaaatgacaactatcaaaccactctaggcctcgcctaagtgctaactagtgccgggggtgccgttaacacccccggctgtacccgctaaacctccacgtatcaaggagaaacatcatggatacgcccatcactctactcgacatcctgcaacaacatcaggtcaccaccttcatggctgcggccatcgtcttagtcgttataatcttctgcgcatggttcttcaaccgacgaatccagaagcacgacgccctcattgcaaaaccgttatgtctgaccgctgatcaagagaagcaagtcagcgtacgacaccaccacaaacctcggaaaattgtgttcgctatccccgcagcatttgcgacaaatgaaaccattcatgcatgggctgaacaagtggctccacgactggggaaagactcctcgcacttcgaggtcaagaccactccgcagaggttcttccgcatctcgaagcatgtagtcaccttcaccaagttggagaatatccgatgaaaaatccattccgcagaaaaccgccgatgcccagtaatcgctatgttctcggcgaagaggtaatccacccgggcaaatacgtctctattccccgatccgcccatttagccattttaggagagtcgaacagtggaaagggaagcgtcatcgccaacatcatcaaacaagaggtcatcatgggcggtgaaatatggttcatcgacctcaaggcaggtatggaggcagctaactatgagtccgtactggaccgcaaagcctacacccttgatgaggccgaggaactgctcagtgcgttcaatgccgacgtggactctgttgcagcggaatggcgcggcaagactcgcaatttagacgattcgcaggttcgtcatcggctgctcgtcatcgacgaagctgccgacatgatcaaatcaggaccaaacaagaagaaatccgactcatgtattgaaatggtacgttccgcactgtctcgttcacgcgctttgaactgcacaatggtggtgagcacgcagaatccgcgtgtcagcacatcgttgccgtatagaagcttgctgctgacgacgctggctcttcgattgaactctaagagtgaagcggtaatggctttagacgaagatgccgtacaacgtggtgcccgcccatggtcgataagtttcaaccgcccaggagacggctatctatgggataccgagaccaattccgtccgcttccttcacgtgccattcgtcacggatgaggagattcactctctccgccgagtaggcggggacggcgacgggcgtagcggcagcggcagcccggtgccggccacgccatcaccctctgaatacagggggctactacgacgcccccccctgttgagatgtgagatgagggacgaatgatgagcgataagaagaacgacccgaatgagaagggtcggtactgggccggcctgatctaccccggcgacagtgccccggataactggcaggagcttatgcaactgtccggcctgcaaatcctcgtgtcccctctgcacgatcaggacatcgctgacgtcaagaccggtgaactgaagaagccgcaccgccacgtggtcgcgatgtggatgaacaccaccacacaccggaacgcacagcggttcttcgagcagttcaacggccccaagacgatcatccgtctggaaagcccacgcggcatggcccgctatctcattcatctcgacaaccccgagaaagcgcagtattcccccgatgatgtactggctttcaacggtgccgactggcagaagatagctatccccgacgacgacaagcaggaggccatgtccattgtgaacctcgtcgccgaaaacgacattcgaggctattacgacctgctcaagctctgcgaacaggagtaccccgacttgctggactatgccacccggcaaacggtgttctgtcgcgaagtgatctggtcatactggcacgcaagcagcgataagcccaagaaggagcctgaccatgattgagagacacacagaggacaatatcgccgaccgtcctcagtttttggacgtgtccgaccttcaagccctgttcggcgtcggtcgctccaaagcacgtctgatgatggacgccctgccctccattcgagttggtagcaaagattacatcaccgtcacggctctgagcaccttcattgtcgaaaacgacggcatcccaatcaaatggcctaagcgcaggcgtaaatgattacataagtcccgtcggacagaccgacgggactttataatgtgtcactgccggaatttcctttgccacgtttcctcaagcgcctgttcggcttcatcggcaatttcctgtgcagttctgatgttgggggttccattcatcgatcgaccggggtgcagagtgtcccacaaagtctgcatacctgtacttcgtcccttgccttgggcatggttgccgaaaccggtgacatgtgcattccatacaggctcataggctgcaatcattgcggattcggcgactggagcccatacgaatgaaagcgtaagcaacttgcatgcgaagtcattgatattgagattggtaaccgcttcaatagacttcgcatggtgccggacacggttggacagccccttttcaggttggttcttatccacgtcttccggcctccattgagtcccttttagggcttttggcgccgccacgccgatatagatgggccaagttcccggctgagttcggttttgctccgccaatctgtgataggcatggaacggtccgtcatagaacagcgcatagataccgtagccatcgaaagattcatctcgaacggtcgtcatcgggtatagttccgatgacataatggcacgggccaacgaatccgagagagccgtatagcttaacgggttgaagaactcaggctgcttcatgctccacctccgacagcaacgaaagttcttcgttcatctccttacgtgccgtatcctcatgcaaagcgaccgcaacacttgaagcaacgacacgggcaagttcgacaggtacggcgttcccaatctgtcgaagtgcttcgctccaagctcccgaaaactcatacccatccgggaaaccttgaattcgtgccgcttctcgggctgtgtagtagcgaacatgtccattcgagaacctcatcatgttctctccccctggaacaccatgcacgccggctttgattgccttagacggctcatccaagggcgatcctgtatgaccggcatacatctttgccccagtacgcaatacatggttcaggaacttcgcagacgctttcttttcatgcgggtcaggaagcccccaaagagcatcacgaactgtacgccatggtctcagtgaagaatcgccggctttccccttaattcccgctccggttttcatattgtgccaagcccaataacgcccgtcttcttgcgcctcaaacaatgcagcttgcgaatgagtcggccgaggaaaagaccattgcgcttcaacatctgagcgaaacccaaccataattactcgatgtcgtcgctgagccacgccgtagtctgcggcatccacaatggttggaaccacttcataacgtagttcgtcatgaatcccggcagtatgttctctgcttagtcgctccgcgtgctcacgccatgtctcatcttccttagctttaacaagcgggtgttgcaaccgcatgagaatgtaatcgtaatagtctcggaaagattcacgggttagtcccttgacattctcgacaatgaacgcacgcggtttgagacgtgacaagacttctgtataggcagggaacatatctcttgggtcaagggcagctcttgcaagaccgcccaaagagaacggctgacatggtgggccaccggccagtaagtcaagatcatccggcgcaagagaccaatctacctttctcacgtcggactcaataatggtcgtatccccaatcaagggataccccgccgcctgattcagacgtagcgtctggcaacagttatgttcccactcgatagcggcgacatgctcaaaccccgccaaagcagtcccgagcatcagcccaccgcctccggcgaagagctctattgcgttcaatcttccgtctgtgttcatgtcccctatcgtaccgaacaagacaagcagcaaaacgcgctaaggccgattctgccagccgtcttcactcgttctcgagaaggctccccatgaaatccgcagctttacggtcattctccccgacttcctcggcatagatgttcagcgtcgtattcaggctttcatgccccagtcgtgcttgcacagtctttgggtctacgccacctgcgactagcagtgtggcctgagcgcgccggagagcatggaaattggggccaacataaccggatcgcttcactcgttcgaggcctcgtttgtcgatgtacttggtttcgttggagtagtgcgcaagtccttccttcacgtaaaacttcctacgccaccggctgaagttatcggggtctaggaaatcgcacagctcattactgcataccggggaactagattgttggccgattccggcagcctcgaacatagctcgttgcttcagcttccactgcttcaagaactcgatggtttgcctgtcaatggagattgtgcggcgcgatttggctgtcttggggtctttgagcaccttctccttgccatactgcttgcggatgcgcagacgcgcaccgtcgaaatcaacatcgtcccagaccaatgccaatgcctcacctcggcgcagaccagtggcaatgcccaaccaaaccgccacgatccggccatcttgcggctcctgcttgatcttatgaacgaacgccaaagcctgctccttggtgattcgcgtctccttacgcttctgctgactcaccttcgggcgcttgatgccttccacggcatcgcacgggttgcggtctatcaactcgtccaagaacgctttacgcatgatttgagataatttcatatgcaccttgtgaatagcatcaggagacgccccatcctgctcggccatacgcagataagcattctcaatcttctttgagtcgaggtcaaccactcgcgtttctccgaggaatttcacgatacggtcaatttcatgccggtcgcgttcaattgtaaggttcgacaccttacccagcgccttgcggtttgcttggaacgcttctgcatactcccccacggtcacattcttaccggaacgctcatcttcgagttcctgcttgtacgccaccaaggcagccgtcgcctcggccttgttgccgttaaccttgcgcgacttcgaccaatgccacgacttgtggttttcatccggcgcaagacgcacgcggatagagtacctgcggccgcgctccagctcggtgatctgccccgacgtttcccgcttcgccatctcggcacctccttcgtagatgccttcatcttatcagatttggacaaatctggacaaagattttctggacaaaagttggacaaacccaccaatcagaaccaacttgaatcactcagcacgccgcattttaagccattgtctcaatgtatactagacaataccaattcagaacaacatgagaaaacgtgggctcataacccagaggtccatggttcaaatccatgccccgctacgaacgtggttatatggccgctgatttcggtaccgaaatcagcggcctttccgtttaccgtggcgatatggatgaaaggcgatcaggcagctacggtgcccagggaagtcggcgatcataaacgtctcgtcattttcatcgcggatcttcagttgtctaatccacgggaggcgacaggcgtgaagtttctcaacgaagcggaagccgggcacaagtcgtatgttacgatcgacttcgtgcccagctcccgttcttctgctcagaagcggagtgtggttcaccatccagccgacatcatcggcatcatgccgcagcgggtcaacgtatcggccagcgcatcgtccagtgcttgaatcggtcatagcgacgacgccaccgaacgacgatggacagtatggcgcctatcgccagagctgacacggccagaaccgaggcaagcgacacatcgccacccgtgacgggcagtgacgggcgagggttgggcgtggttgcctccgccggcgccggcggcgtctcgggtttctccggttcgcacggtttctccgactcgcatgggggcaacacccgcacacgctcccaggcatcgtcataccggctggacgccggggaaacacggtcatccccctcgaaccgccagacgaacacgtaccacccaggccgttcggcggtcagatacataggagcgccatgcgcgtccaacgccccggcgccgattttgaacgtgccgttcatcgcgggaatctcccaggtggccagcaaccggtggttgtcgtcttccgtgggaacctctcccccggatggcttgtacgcctcatcgttggaggggttgtcgggatcgccggaccaccatacgctcaccgtcgcatacggccgatccgccgcgaactcatactcttcgttgccggcatactggccatgatccgcagggaatcccgatacggtaatggtgtcgctgagctcggcaccgatatccgccgaatgctcagtgaccgtcgacatgacttctagcttcctgcgacttgtattgctttccgtagcctccataaacggacttatccagtcgcctataaggtattcctgcgcctgtttgctctgctcggaccgccgaaacacccatacccatgtgccaaaaccgctattctgcttggtccggtaagcggcaccgtcatccggcttggtcatggcctgcacacgtgcctgctgccccaccccggtgaaagaggccttgccataggccaccggctcataacccaaagtcgccaatcgcgcaagaaaagcatcggcgctctcttgtgcattcggcgtaatgacattgcccacatcgcccgtatcaagaccatcgaaatagtatccgcgggcctgcaattccaaatcgggcacccaataactgtccgcatccgccacgccactggtcacgtcatcgaacaccggagaagccacatcaagcaccttctcggagaccttggtggataccgccggaacaaaatccttacgcacccgaaatgtcgtcgacgcgccgccagtggaagccatcgagtcaaaggccagcatgtcctgagtgctgtccatgacgtgcatccgcccatactcgtatgtggtgttcgccgtcacctcgccggcgccggtcgcctcccacgcgatcgaggacccggcgctcgtcgacacccccgagaacgtgttgccgccttggacgaaccgcgccgccccctgcaaggtgacggtgaacggcactcccgcgatcgcgtcaccggcgcggttcaccactttcaccgagatggaaccgctgcgcaaagcctcggcatcggtgcgttccaccgtcgtgcccgcaggcgtcttgccggccgattgatcccatatccgggccgccttcgccacgatctcggggtaccggccttgaatgaccgccatctgtctcgcccactcgtcccgatcgcgcccgaagtgatcctgcacgatgatgccgatcgccgcatgggtggcggcatccgtgtcgcggtaccggtcaaggatccatgccatacgccgggcgttctcatcggaggcaagcaccgtggtggggcctatcacatagtcgctcagtttccccgcttcgatgcagtagtacttgttgcccgaagcgtccagccccgcgacaccgacgtaatattccatatcgttgtatggaaacgccacgtgatatctttcgtcggcgggcgtcaacgtcgcggcatacgccgtattcgccgagccgaacaccactcccaccattattatcagaccggtcagcatcgctacgatggccatgccccgttgccgccatgtcgttatcatcattcgtcctttcctggtacgtttccccgcatactgcactgtgtgcgggtaggccacgatcatggcagattttcattcgctacagccggtttttcgacctatgtggtccgagcttgccgtttgccggcgagttgtggataactcttccgccgagttatccacctcatgcggttgaccgaacgtttacctgatagttatccacaatgcgcaacatatgttcaaaagcccttagaatagggccttatggcagcagtacaacatcgcgcgaccacgcgcactagtaataccgataacagcaccacgaaaacgaagtcaaaggcgacttctgcccgaaagagccccgcaaccaagcgcaagagagtcagcgccgaaacggcacgcgccgcagcagcgctgaaaggcctggctgtcgaagcccccgcaccgtccatcgaagcaaacgagcccggccagttcggccgcatcaatgtcatggacatcactcccgccgaggagcgcggcatcttccccgcccgtgtggaactcggcgaaccgtttgagatgaccgcccaggtgttcatcgaaggccgtaccaaggtgggtgccaccgccatcgtgcgcaacccgcgcggcaaggaaaccatgcgccgggccatgacctgcgtaaatcccggcctcgatcgttggaccgtgatggtcaagtgcggcgagcacagcgatctgaagccttgggaggatggctacgcggccgtcaagcgtcagctcggcgaatggaccgtgaccatcgaaggttgggaagacgcgtacgtctcctggctgcacgacgcccgcatcaaggtgcgtgtgatggacgacgtggacaacgcactcaattccggtgccgagttgctggcccgttgggccgaaaccccggacaccggcctgaccgcacgcgatcgcaagaccttggagaaggccgctgagaccatggccgatcagacgctgagcgccgaggatcgtctcgccgccggcgacaacccgaccatcgccgccctgcacgagactcacccgctgcgcgacggcatctcccccagccagccccagcgcttcaaggtggaacgcccgaagtccagcttcgcggcttggtaccagttcttcccgcgttccgaaggcgccaccatcgatccgaacaccggcaagatcattcagggtacgctgaagacttcgatggccggcctcgaacgcgccgctgtcgagggcttcgacatcgtctacctgccgccggtcttcccgattggcgtgaccaaccgcaagggccgcaacaacacgctggtcgccggccccgatgacccgggctccccgttcggcatcggctccgagctaggtggccacgacaccgtggatccactgctcggcaccatggacgatttcaaggccctgtgccagcgtgcacatgaactgggtctggaaatcgcgcttgatttcgccctgcagtgctcgcccgatcacccgtgggtcaaggcccacccgaactggttccgccacaagccggacggctccatcgccttcgccgagaacccgccgaagaagtatcaggacatctacccgatcgacttcaacgccgacatgcccggcatcgaaaaagaagtcgaacgcatcatgaatctgtggatcgaggcgggcgtcaccatcttccgcatcgataacccgcacaccaagccggtgcgtttctggcaggacgtgattgccgccgtgaccaagaagcacccggagatcctgttcctggccgaggcattcacccgcccgggcatgatgcgcgccctgagctacgtgggcttcacccagtcccactgctacttcccgtggcgcaacaccaaggacgaactggaagagtatctgccggtcaccaatggcgacgacggctactaccagcacaacaccttctggcccaccacgccggatattctcaccgcttacgtgcgagacaacggcgtagccggccactgcgtgcgtgcggtgctggcagccatgggctcgccgtcctggggtatctacaacggttacgaactcatcgagaacaagcagcgccccggcttcgaagagcagatcgacaacgagaagtacgaggtcaaggttcgcgattggagcaaggccaagcagtacggcgtggccgagatgctcaccgcactcaacaagattcgtcgcgcccacccggccgcgttgagctaccacaacctcaccgtgctgcctacgtccgacccgaatattctggctttcgcacgccacacgccggccgaactgaccggtaccggccaagcggacacgctgattgtggtcgtgaacctcgatggacacaacgcacaccagtcgatgattcacctggaactcagcgagctgggtctgcccaccgaccgcccgctcaacgtgcgcgacgagctgaccggccgcgaattccagtggggttgggacaactacgtgtctctggctccttgggcggatgtggcccacatcctgtccgtgcagtgatgcggtactgcaacggtaatgcaacagtgatgccgttgacgtgcatgggtttatcgtgcgcgtaaaccgctagaaatcctcccctcaaggggaggatttcgtctgtttgggcatagtgtcggcataatctcagcacggtttcttgagttccgcacctgttttgcaggcgtaaacagggtattgtggtgagacgataacgtaactgtcgattttcaaggagaaatgacatggcagaaaccttcaacgtcgttgtggaaattccgcgcggctccaagaacaagtacgaagtcgatcacgagaccggtcgcgtcttcctggaccgtaccctgttcaccgcaatgggttacccggatgactacggctacatcgacggcaccctgggcgaggacggcgatccgctggacgctctcgtgatgattccgaactccgtgttcccgggctgcgtggtcgagtgccgcgccgtgggcctgtaccacatggtcgacgaggccggcggcgacgacaaggtgctgtgcgtgcccgccgacgttcgtttcgatgacatcaaggacatcgacgacgtcaacgagtaccacaaggccgaaatcaagcacttcttcgagcagtacaaggctctggagccaggcaaggaagtcctgccgggcgactactggactggtgctgacgccgccgaaaaggaaatcattgccgcgcgtcagcgtctcgccgattccgagaagtgattcgattctgaatcgttgacaggaggccccttcgggggccttttgttgtatttgtggcaaagccgctctactctcccccagtcgcagtttcactgcgccagctccccaacagagggagcttgtattttgtgatacagtaatgttttgtcttttcaactaggcgtaggcggcgtgtaggaacgctggtcgaggcccatcgcacggtaatccggcgatgaaccttctgtcacaccatgatttcgataatcattcaaatcctgcttatttctgtttccgtagctatggatgcattcgccgtatccattggcaaaggcctgaccgtatcccgcgtacgagtacaagacgccgtgaaaagcaccctctggttcggcggattccagatgctgttccctattctcggctatttcgcggcatctacattcagcaaatacgtaacccaattcgaccattggatcatcttcgccctgttggtgttcatcggcggcaacatggttcacgaagccttcgaagaagatgaggaaaactccaaggagaccgcccagttcgattggaagcatatgcttcccctggccgtggcctgcagcatcgatgcgttcgccgtgggcgtgagcctggccttcatgttcaccaaagcccatatggcattcgccatcctcagcatcggtgtggtcaccggactgttctccgctgcgggcctgcacattggccgcgcgttcggttcccgctggcagaagccggcgcagatcgccggcggcgtggtgctgattctactcggcatcaaagtgctattggagcatttgggcgttatcgcgttctgatttagtgccataagccccttcaccagaaggggctattttgtttgatttcaccgttccaatgcccgacgtaggattgggatggaaattcgattatctgagaggcgtatcatgaccgagatcacccaggagggttggaagaacaaagctctgagcatgttgttggcccaactgacgtcctatgtactgttcatcgcagccacggtcattccctcccctggcaccgtccccatcatccctttgattatcgccgctctgacgttggccgcatttgtcgtattctggccgttccgcggcagcatactggatcgtatcgtcactttggtgtttggcgcgatttctctgattttcgtcatcgtacctttcccgaccggcgaggttccgccggatcagaccgctgcggatggctcggtacttccttggtattcatgggcactggccatgggcctgctgctggtggtgctggtggtcttctccttcggacgccagatggctcgtgagaagcgcgaacatcttatccgcgcactctctcacgccgtgacttccggtgtggcagctctcgccgtggccggctggtgcttcctacctgatttgggcgcgatgctcgccaagggcaccgttgcgggaaccgttgccctgatcatcctcatcgttttgggactggctttggccgtggcttccacgttgtgggtgcgcgacgccgatccggacccggatatccgttatccgtggatcggtaccggcctgatgccggtaatgctgatgggcgtgaccatcgccgcaaccgcactggtgctcggccgtatcatcggttgatggacgtccaccgttccatattccgcaaacttgtaacctatgtgtccactacaagcgcgtagaataatgaaaaccgtgcgaaagcggcataacgccgctgacgactcgtacagccacaccgagcaattgcgtaacacattgcaggataagggggattagcgtgacggatcttacgttgatgactttcgccagcgaccccgccaccgttttgccatcactcgccctgctttctcatcgcgtccgcgtactgccgatggatgcagccagcttggtgaagatgccggagaacaccattctgtttctggatgcacgcgatgatctggcgaccgccaaaaccttgtgccgcctcatccacgcttccggcctgtccacgccaatcgtgctggtgctgaccgaaggcggcttcaccgtggtcaactcccagtggggcattgcggatgtggtggtcgccaccgcttccccggccgaagtcgagggccgattgcgattggtctccgagcgcggcaacgctcccgcagccgcagcagccggttctcccgccgaatccaccaccacggtggaagatggccagattcgctccggcgacctcattgtggacaccaacggctataccgcctccctgcatggacgccccatcgatctggcatacaaggagttcgaactcctcaagtacttggtccagcaccccggccgcgtgttcacgcgcgcccagttgctgcaggaagtatggggctacgactactacggtggcactcgtacggtcgacgtgcatatccgtcgtctgcgcgccaagctcggcggcgaatacgaacacctcatcggcaccgtgcgcaacgtgggctaccgattcgacccgccggagacggataaggaaactgccgccgcacagcaggccgccaaagcatcctctgccgccatcgacaccgatgacgatactcccgatctcaacaccgtcgcctgacagaccagcggcgctgcaaactatcaatcatcgatattacgccgcttaggtccatacgatgagagaaaccaaatccgcgcgtctcacgcgcatgcatgacgaatacgacattctgcgccaggtgattccggcacccgcttgcgcactgcatttctcgaatccgctcgaattgctgatcgccaccgtgctcagcgcccagaccaccgacaagcgtgtcaacacggtcaccccggaactgttcgccacctaccccaccgcccgtgacttggcggccgcaaacccggcccaagtcgaagacatcattcatccgctggggttctatcgttcgaaaacccagcatctcatcggactggccacggcactggacgaacgattcggcggcgtggtgccgcgcacgatggatgaactgaccagcttgccgggggtcggccgcaaaaccgcgaacgtcgtgctcggcaacgcgttcgatatccccggattcccggtcgatacgcatgtgatgcgcgtaaccggacgactgcgttggcggtcggattggcggtccgcacaccctgatcccgtgaaaatcgagaaggaaatcaccgcctgttttccgcccgaagagtggacgaatctcagccaccgactgattctgttcggccgggccacctgccacgcacgtacccccgactgcgccaactgcccgctgtccgacacctgccctagctatgcgccgcccgccggcaagagcacgtccaagcgctaactcatacctcatcatggtgaattgcggattctaggctgaatccaccgctagactgaaaaccatgcagcacagcaagcgggacaatacatggtccaagtgggggatttttctcggagtcgccgtggcactcggcgcactcgtggttgtgggatggacgttcatgcaaaaccggttccagccgggatcatccctcgatgccgatgtgaccattggcatcgacgatatgccgcaatccttggatattcggtccgattcctctgcggcagccgaacgcctgctcgtcgacaatgtgtatgagacattagtgaccgtcgatcaagacaacaagcttcagccgggactggcgacaagctggaagacttccgatgacggactgaccgtcaccctgacactgcaatcgggcgtcaccttctcgaacggccatacgttggacgcctcggacgccgtgtggtcgttgcaacagaacgtgaccaacaaggtggcggacgtcgacgaattgggcgatctggcgtcggtcgccaatccgaacgccaccacggtggtcattacgcttgccaagcccaatccgacgctgctgcgagcgctgtccggcagactcggcattgtctacgattccgagtcgtccagtgccgattatcaacgcaaggccataggttccggaccattcaccgtggccgatttccagcctggccattccctgaagctggcgcgcagcgatacctaccatggcaccaaagcggccagcaatgtcgttgaatttatgcaatactccgacgccgatgcgctcagcaaggccctgaccgacggcagtctcgatatggcggcaccggtttcggcttcgacggccaccggtttgaacggcaaggatggcctgaccgtcaaggagggggccactacggataaggtgctgctggcctacaacaacggcaccgattcgctgctctccgacgaacaggcgcgtaaagccttccgctatcaaatcgacgcagccggcatcgcctccgcccaacccgacgcagccggagcattgggcggccccatcagcctgctggaacccggatacgaagatttgaccggactgtacccgcatgacgaaaaccaagctgggcagatgttctcctactttggtgcgcaatacctgactacggtgaatctggtggttcccgaagaataccggtcgttggccgaaaccatcaagcagcagatcgagcggcagccgcgccccacggtgaaccttgaagtgctctccgatgaggattatgccaaacgaatcaaggacggcaaatgggaactgaccgtgatgagcatggacggcacggatgatgccggcatattcgccgaccccgattccatgttccattacgaccataccgaagcgcaacaggcctatgcggatgctcgcgccgccactaatgacgccgattatgaggcacgaatgaaggcgtacgcccggctgatcagcgaggatgcggccagtgattggctgtatacccgcaaatgcttcactgtggcgtccaccaaggtctccggctacccgacctcgatgatcaatcgccgcatgccgctggccgggttgacggtgaagtaggcaaccttcagtcacggacgggctacgcccgatagtccttggctcactatcgttcgatcgttcgtacctcgcctgcgaacagcctactgggctgtttactgtacagttcggcttgtcatgcaacgtgcataaactttggccttatgactgaaggcaaatccatcatcaacaccaacctcaccccgctgcccgacaaggtcggcgtggacggacttgaggacaagtggcgcaccgtctgggatgaagacggcacctacaaattccgcaacacccgcgaccgcaaggccgtctactccatcgacaccccgccgcccaccgtctccggttcgctgcacgtgggtcacgtgttctcttacacgcacaccgatgtgattgcgcgctacaagcgcatgcgcggctacgacgtgttctacccgatgggttgggatgacaacggcctgcctaccgagcgccgcgtgcagaactactatggcgtgcgcgtggacgtgtctctgccttacgacccggacttcaagccgccgtttgaaggcactgatggcaagaagattgacgccaaggatcaggtgccgatttcccgcaagaacttcatcgagctgtgcgagcgtctgactgctcaggatgagaagctgtttgaggccctgtggcgcaagctgggtctgtccatcgactggtcgcagacctaccacaccatcggtcagcacccgcagcgtgtggcccagaaggccttcctgcgcaacctcgcccgtggcgaggcctaccagcaggacgcccccggcctgtgggatgtgaccttccagaccgccgtggcccaggccgagctcgaatcgcgcgaataccccggcttctaccacaaggtggccttccgctttgaggacggcaccccgatctacatcgagaccacccgccccgaactgctggcggcctgcacctcgctgatcgccaacccgaacgacgaacgctacaagcagtacttcggccagtacgtctactcccctctgttcaaggtcaaggtgccgattctggcgcacccggccgccgaaatggacaagggtgccggtatcgccatgtgctgtacgttcggtgatgtaaccgacgtcgagtggtggcgcgacctgaagctgcccacccgcccgatcatccagcgcaacggccgtatcgtgatggataccccggactggatcgaggacccggccggccgcgaggtctttgccgaaaccgctggcaagaccacgttctccgcccgcaagatcatcgtcgacaagctgcgcgagtccggcgatctggacggcgagccgaccccgaccaagcgtatgacgaacttctacgagaagggcgacaagccgctcgagatcgtcacctcccgccagtggtatttgaagaacggcggtaccgacgccaagctgaacgccgagcttatcgagcgtggcaaggaactcgagttccaccccgacttcatgcgcgtgcgttatgagaactgggtgcacggcctgaacggcgactggctgatctcccgtcagcgcttcttcggcgtcccgttcccgctgtggtacccggtgaacgcttccggcgagccggattacgatcacccgatcactccgtccgaggatcgtctgccgatcgacccgaccatcgacgtgccggagggctacgacgagtcccagcgtgatgtgcccggtggtttcaccgccgaaaaggacatcatggacacctgggccacctcttcgctgaccccgcagatcgtgacccactgggccgagccggacgaggcctccaaggccctgttcgcttccaccttcccgatggacctgcgcccgcagggtcaggacatcatccgcacctggctgttctcgactgtggaccgcgcgcacttggagaacaagtgcctgccgtgggcccatgccacgctgtccggctggattctggaccctgaccacaagaagatgtcgaagtccaagggcaacgtcgtggtgccgaacgagccgatcgagaagttcggcgcggacgccgtgcgttactgggccgccgccgctcgcctgggcctcgatgccacgtacgacatcggccagatgaagattggccgtcgactggccatcaagctgctgaacgccaccaagttcgcgctggccatcggccgtgaggacgagaaccatcacgtgggcgctgccgccgaggccgcgtggaacccggccgatgtgaccgaaccgctggatcgcgccgctatggccaagctggctttggtggtgcgtcaggccaccgaggcgctggaatcctacgagcattccaaggcgctggaagtcatcgagtcctacttctggcagttctgcgacgactacatcgagctggtcaagaaccgcgcctatggcactccggacgagcacggcaatgtgccgtccgagaaggctgtgaagtccgcccgcaccgctctgggtctgggcctggacgccttcgcacgtctgctggccccgtacctgccgtacgccaccgaggaagtgtggagctggatgcacgccggttccggttccgtgcatcgcgccgcctggccggtcgtggacccgtatgtcgaggccgccaccggtgcttcccccgaactgctgacttgggccggcaaggccgtggagcagctgcgtaagatcaagtccgaggccaaggtctccatgaagaccccaatcctatctgtggcactgtccgctgcttcggaaggtgtggaagcgattcacgccgccttgggcgatatcgcgcaggccggtcgcgtggtcggcaagttcgacttggtggccaagcacgccgaggaatccgccgccgaaggcacgcccgaaaccgaggtcgccgttgaagccagcgagctcggtgagccgccagctaagaagccaaagcactgaacgttacgcacaacaacagtaggtctcacggcaatgccgctcgttccgagcctatgggaagcccaccgggcttcccgcttaacggctcggccagctaagaagccaaagcactgaacgttacgcacaacaacaaaagaggggaacctattgaggttcccctcttttgttttttgacgttcggatgacacgactgtgggacggcacgcaaatatcccgcatacaccatcacaccgtcggaatcacgatgagatatcgggtttcggcggttttttgttgcgtattggggctgtcgagctgcgcgacggcctgcgccaagagcgtgccagcatcactgattttcacggtctcattaatcagcgcgttcatatcgtgcttgaacagcgtgccgccagtgccaaagccgaacagtactggagcggtgtcaagattgttgccggaatcgctggcgttggaggccttgccgttgccggaatcgccagtgtcgctcgacttggctgagtcgttcgttcccgaaccagcgctcttagacgagtcggacttatcaccaccaccgatggccgaagtaagaccacccgcatagttcatcacatcgccagcagacatggacatggtgtcatcgaccagtgaggccttggaatgctgcgactgctgctgttgcgcggctttggcctgcttacgggcggcatcggccttacgcttggcttgggcgacccgggtcttgccgtagaacgattgcgattgcgaatcgaccaggccggtcagtgcctgagcctcggtcaccggatcggaagagacatcaccggacgaaccatcaccatcactgccggaagccgaggacgcgccgccttcgaactgatcggagaatcgcaatacaatctggcgcaaggccgtggctttgcccgtatgctcggaggcggtggcaagcgtgctcatcgcggcatcgaccttggattgagcgtcggcgagttcatcgctaccgttggtttcggcgatggcttggctctcgtaagcggtggcgcccgaggacgtgccgccggtcagggcgctcaaattggccgtgtaaacgtccgtgtatttcatcgaatacggaatcattgcggcggagagctggctctggccatcggcgtattgcttggagccttgagtggcttcctccgaagcctcggcgatcagatcatccaccagtccggtggtgccttgctgctggatgcggcgaatcacctcgtccaacgcatcgaccgcaccggcatgctgatgtgcggcactgacgttgttcaccgcgttggccaagtcgagtacggcttgagccaaaggcgtgtccccggacagttcgccggccgtgcccatcaacgccggcaactgggtggaggtgccaatcgatccagacaggtgcgtggtatatgagcccacatacgcggccatatagtcttcaaacgtccgcttatgggcggtttcgcgttcggccactacagacttgttcagcgcacgttcgttatcgcgcagggtttgaagctgctcgatgagctgttgctgttcgccagaaccggcgtcggtcagtgaatcgaccagtgtggcggcagaggcggtgagttgggcgacatccgtatcggcagcaggctgtgcggcagcattcgcagcattcgcggcatcgggattagcaccaactgccggactgctggaattggaaggcaatacggcgagcgccacggaactcatggagaagtctttggcgttcatatagcagctgaattccaagccggttgcggcttttccagctgcggcgactacggtattggaaccttgcgtggtcaccgtaatggagttgtcagcggaaacatcatcggctacctgcgtaggcacggtaaaggcgacaaccgggatcgtacggttggcttccttggtttgcggcttaatatcgatatacacgccgatcagtccagacgcgccggcaacctcgtttgcctcgacgttcggaccgtcaagcgagtaggtgacgctgactttccatggcagggtggcggcggaagcggggatacgagaaaccttggacgtgccggaattactattggcggaatcggtatcagtggaaccgctattgccggaatcggcactggcgccattgccggcgccgcccttccctaccacataccaacggaccggctccccttcggcatcggtgacggcgtacatatcacttgccgtagcgagcaccggaccgtaatcaaccggagtcggacgagacatccaagcaccgccgagaatcgaagccacgcacaatgcgcaactgaccagtgcggcaccacatctcatctacgtatcccattcatacagtcgaccactacgggcattccattcccgtattaatgtagtcgctgcaggcaacttgccctatagacgaatatccgaaaggtgcccattcgctgcgggcgaatcaggcgaatacgtcgagtacgcccgggtcaccaccggcatcggctatgcgctggtggcgcttcttggcttcggtaaccacgaattcacggtacatttcggcaatttccggatcaagcccggcatcgatggcgatgcggtggaggcgttcgatctgatagtcctcacgcttggtgtcttcgggcgcgaatccggcgttggctttgagcacgccgacctgcgaggtggccttgaaccgctcggccagtaatgcgatgaccgccgaatcgatgttatcgatggtttggcgcagcgctttgatgcgcgccaccgcttgtgcggtttccgggtgggccgccgcctgggcggagtcgatggtggtcctttgccagtcgctgctcgtttcgctcatagattcgaggatactcccgattacggctttgcacgatgcgcaaagtcagatatctcagatgtcatagtcgccggtgaggatatggctggcatccgcatcgccgaacatggccgcaccactgcccactcccaaaacaatcgaacccagtgatgcctctttcatctcatatatcgtcagcgtgcatgtgaacgttgacggcaatactacaactgcaatgtgatagttgatgtatttgcatcagatacgacaagggctgcaccccgtatcaatcagggtgcagcccttacactattgttcagcggtctgatcagttgccgttgaccgcgttgccggtgttggcctgctgcacgatggcggcgaggaagtcgcggttggtggcggtcttcttgaggcgcggcaccagcgtctggtaggcctgctcgggctccatgccgcccagcagtcgacgcagacggtagataatcggcagttcctgcgggttggtgatgagctcctcgcggcgggtgccggaagcgttgatgtcgatggccgggaacagtcgcttgtccgccagctcgcgggacaggcgcagttccatgttgccggtgcccttgaactcctcgaaaatcacctcgtccatcttggagccggtttccaccagcgcagatgagatgatggtcagggagccgccgttttcgatgttgcgggccgcaccgaagaacttcttcggcgggtagagggcctgcgcgtccacaccaccggacaggatgcggccggaggcaggggctgcgatgttgtaagcgcgagccagtcgggtcatggaatcgagcagtacgaccacgtcctggccgagctccacaagacgcttggcgcgttcgacggccagttcggcaaccgtagtgtgatcggaggccggacggtcgaaggtggaggaaatgacctcgccctggaccgtgcgctccatatcggtgacctcttcgggtcgctcgtccacgagcaccaccataaggtggacctcggggttgttggcggcgatggagttggcgatgttctgcagggtgatggtcttaccggccttcggcggggagacaatcaggccacgctggcccttgccgattggggaaacgatgtccatgatacggccggtgagcttgttcggggcggtctcctgcttcaaacgctcctgcgggtacagcggcgtgagcttggagaactgcggacggttgagcgcttcttcaacgctttggccgttgatggaatcgatggcctgcagcggcacgaacttctggcgctggttgcggcggtcgccttcacgcggggcgcgaatcgaaccatgcacggcatcgcccttgcgcaggccgtacttcttgacctggcccatggaaacgtacacgtcgttcgggccgggcaggtagccggaagtgcgcacaaaagcgtaggagtcgagcacgtcgacgatgccggccaccggcaccagatcctcctgcggctcttcgcggcggctatcacggtcattgcgatcgctacgattatcgcgatcatcatagcgacgatcatcatcggcgttgtcgcgatcacggccacgcatgcgacggttacggcgatcgctgcgatcattacgggtatcgcgatcgttgcgatcgctacggtcgcggcggttacgacgcacgaactcgtgatcgtcgttctgctcgccgtcttcggacgtttcctcgtgcttctgcgtgggcagcgtggccaggatatcgtcgaggtcacgcacggtttcttcgctgttttccgcagtgcgacgacggcggcgaggctgctcgtcctcatcatcacggactcggcgaatcagcggaacttccacgtcctcgtgacgctcgcggcgacgctcggtaggcgctgcatctcccaaatcgagcgtggccagcagatcgccggcctcatcggccttcttgcgcggcttgcggcgagcgaaatcgggctggtcgtcatcgcgacgacggcgggccgcacgcggttcggatgcggcatcatcggcggccttacgacgggtgcgtcgcggttcggtctcgtccttcttggcatcgtcggccacgggaagcggcaaatcgagctgcggttccgtggcagccggagccggagccggcgactgggtggccacgtcagcattgtctgtggtgttggcctcagcggcatcggactgcggagccttgacgaccttggcggttttggcggccttgggggcgcgcacggtcacaccggccggcggctctccaccattgcgcgccgcctgcagggtggcgagcagctcgggcttgcgcatggtcgacgtgccgcgcaggcccatctgtttagcgagctctttgagctcaggcagcttcatatcctcaagattctggctatttgccactggttgccctttccataccgaacagacccatgcctatccaggcgttaagagtgattattgcggttgcaccgctcatgaatgttcgctgcgtctctgagtctctgcgaacttcgttcactgtacaacgccaactcgaccaacgcaaaacggcccgccgaaaaccaaaaaagctccctctgtgacgagggagctcaacaaggtttattcacttttcttcgtggtaggacttttcggtgttgacggaccacacgttcttcttggacgtcttgccggtcttgatgttgccgacggcctccatggcggtggccatggagtggtccatgttgttgtagcggtgctggccgttacggcccacgcagtacaggttgccgaagccgtcgaggtactcgatgagctcgtccatgtgctcataggtgtcgaagtaggcggggtacgccttcctgacgcgctcacgatgggagtcgatgacctcgtccggaccgttgatcacacgcatgcgggtgagctcggaaatcgcgaacttggtgacatcctcctcgctcatgttccagaacgagtcgccctcctcgcagaagtactcgagaccgatccacacggtgtcgtccacgtccttgaccaggtacgggctccagttgttgaagatctgcagacggccgaccttgtagcccgggtcctgcacgtagatccagcagtccggcacgatcggcggattgccgagggtggggatgctggtggtgttcttgagcttcaggtgcttgaccagcaggcccacggtcacgaaatcgcggtacggcaggccgttggccacctcggtcatatcggccggggcgggcttggaatcaacggcctcgggatcggcgccggccgcgtcgatggcgttgaccaggtccttgaccggcatcgaggagatgaactggtcgccggaaagctcggtgcggttgccctcggaatcctcgtacaccacggaagacacggcaccatcggtctggcggacctcgaccaccctggcgtcggtcagcaccttgacgccggcggcctcgcaattggactcgacggtctcccacagctggccgggaccgtacttcggataccagaactcctcgatcagcgaggtctcgacctccgcgttggagcgcttcttgggcagcagcttctggaaggcgttcttgagcacgcccatgatggacaggcccttgacgcgctgggcgccccagtcggcggagatctgggaggggtggcggccccacagcttctccgtgtagccctcgaagaacatcgaatacagcttgcggccgaaacggttgatgtagaagttctccagattgtcttccggcagcttgtggaacatggacttcaggtagctgaagccggccaccatggtgagcttgaagcccatggccttcaacgtgttggggctcagcgaaatcgggtaatcgaagaagtggcggttccagaagatacgggacactcggtggcgcttgagcatcaccttgtcctccgtctccggatcggggccgcccggctccatgtcgtggtcgcggccgagcttcttgtcatcataggagggtgcgccctgcaacggcagaacggtcttccaccaatccatgatgcgttcgtctttggagaagaaacggtggccgccgatatccatgcggttgccgttgtgcttcacggtgcgcgagataccgccgaattcgcgggtcccctccagcacggtcacgtcgtacttgtcggcaccgccgtccttgatgagttcccatgcggcggtaagtccagccggaccgccgccgataatcactacggattgcttgtcggtcattatgctccttataaacgcaaaatcagagacagtctactagaagccccggaatcgcacaccgaaagatgagcgaatgcttacagaattctcccgatatacgaccgatgcgccgtctttccatcagcagaaaggcgacgcatcgaatcgtgaggtaggggtattcggcaacgttgcgtcacacacagcgcggcgaatcggtttggtcttaggctaattcgtcagcgacgaactttccatagattcagcgagatgcctgcaagtgcaagcagcatcataatccccgcaacaccagtaacggcaacaccagtacgactcaactcgttttccgtaccattagcctgagtgttgctgggctgatgagttcccgcaccattgttattcggagtggtactcgttccttcaccagtgttaggtcctgtgcccggctgcgttgtggaatcatcagtcagatgcgcatcgtcgcctagggtttggtggtcggaggccaagcaacttttaagctcagtgagcttgtaccacgtggaaccatcggcaatcggcgtgcattcggagcggaaggcgatttcctgctcgttgtagagcatacgaacgagcggcgtgtaggcacggccggtcttcgggtcgttgccggatttgacggcaacatcccactgcacattagcggccatcggagtcaccgattcaccgcgccattcattgttggcgtaggtgtacacgtcggtggtgctggcggccgcctgctgggtggaaccgggaaggccaagcagcgcggcgaacggcatcatcgtttcggcatgggcaaagcggaaagtagcaacggtggatccgccgtttacgcgctcatcaatcgacgagaagaaatcgtcaagcagcggctgtgcgattgtgtaggtctcgtcttggccggcgtagctcgggcccttctcgtagaagtcctcggcgtcaagcgcccaggcgaacaacttggcgtcgtctgcctgctcaccttggaagtactggttgaagtcgaaggtatggctgccggtgttctcgttctccatatcagcggcgatgatgtacaggttgtacagatccatcgcggcatcgtattcggaggcgatcttcttcttggctgcgccgcaggcgtcggcatccttgctggggtcggctcccggcgcgcagttggcctcgccgcccttggtgccatcgacagtgttgtaccaggcgtacgtgccgtcggccagtttggcgaggaagtcatcggtgaagatttgtgaaagcaaatcgtgagaggctgttttcacgtcctcgttttcggcgatggtttgctcagcgcctgcgataatcgcatcgttttccacgaagttctggtaatcgtcggcacgctgcttggcctcaccggttttctcagtgccgtccgggttttcggacttgtggaagtacagcgtgttcggcgtcttgtcgaaagccgccgcctcgccggtgccggccggatcggcgggcgtcacagtgctgttcgccagtttattgttcgaggccgcgttgaaaccgcgagcaaaattctcgcctgattcagtagcgcgggcttcgccagaggactgataggcaatcttgccaccgtccttggctgcgttgtcgaacagcgtcttgttgcgctcgtaggcacgtgcgccaatgccctgatgttggtcagcaccctgaccggtgagcataccgtagccattctccacatttgcggcggtgatggctttgagattcttcatgaattcggacttgatggcatcagacttaaaaccgttatccgcttcggcggcttcggccatcttcataagcaatgcgtcgtatttgtagctggacaggccgcgtgaaccgtggcgagccatcgactcggtgtataccgtttcgtagccttccggcgcctggctatagctggcagtggtcgcttcgctaggtgccacatatggctgcttgctgctgtaatactggccatcggcctccaaagccatggcgtgcggaacggtcaggatgccaccggccagcaatgtggcggcagcaaccacgcccgcgatggagcccttaaggccctgctgcatatggtgtgtgttcatgcagcattttctatcagccgcaagcaaacaagacacacgatggcaaggttacgagtctgaacttttgctatgcgttgtatgaacaatgcgcgacgccccgccgtaagatgacggaatgccgcgcattgtcaatacaggctgtatcagacgattgcctgtcagtgaatatcgtcgggaatgtcgatatcggttttctggacttcttcgacgttcacgtccttgaaggtcacgatgcgcacggacttgacgaaacggctggaacggtagacatcccatacccatgcgtcagtcagctgcacatcgaaatacacgtcctgaccagcggaacgcacgttgaaatcgaccttattcgccaagtagaagcgacgctcagtctccaccacataggtgaacagcttgatgacgtcacggtattccctatacagcgcgagttcggcgtcggtttcgtaattgtcgagatcctcggcactcatgcttgtttactcactcactttccgtatcgcgtttgcggccgcggcccagcgtacgccaccatgcttcctttgagggcttgcgttctgcctgaccgtacggccagttgctttcctcttcgagactgtggcgcgtgttcttctgcgtatcgtcgtggtgctcggcctgtggctcgactggctgtgcggccgccggcgtctgggcctgggactgcacgtcactcgtcgtggcgccggctgcctcaccacgctgtgccggctcgggttccggcttgttctgctggatggcgatggaatgctcgcgcgcggacagcgcttccttgacacccgggttgtcctcaatcaagtgcatgccaaaagcgtcaagcgaacgaatcggatcgtactcgtcagccaacgtgtccatgacgataaggtcctggtatttgttgttttcggcatcccacaacgcgtcgcgcgaggtgccggacggcacgaagccgagcgactggtagaccgaaatcgagcggctgttcttttccggcacgctcacccagatgcggtgcatgcccaagccggccggttcgggcgcgaaaccgtaggtcatcacacgcggcatggcgtcacgggagtagccgcggccacggtattcacggcccaagatgatctggatgcgggcggacttggaccagccgtcgatgtcgataaggaaaatcatgccgatgacattatcggtgctggccgcatcgagctgaccgtcatcgtcatggtcggcgtcagtcaatacggcccatgcgatggtgcggcgggattccggatcacccacaccggattcggcgggtgcctgaccggcttcccaagcctgggagcggcggacccacgtgtgtacgatggcgcgttcggtgaccgcatccttacctgtgatcttggatgcgccatagaaggcatcaagttcatccaaacgaggcaggtcctcgacggtggcggggcgcaggtgcaccatttcgccacggattggcggaatgacgatgctctgtggcagatcgcgcttcagttgcgcttcggtagccatgctcagcgtctcgttggttgcggtcatcggtatacgtcccccggttcggcttgtttcggctcacggtccagtgccgaacatatcttactcgactgggtgaacgctggaaatgctctgagtcgactttcttacagaatcaataaaggctcccgctggcgggagctgtctaacggatttgaactggagaatttccctacaaataagtgctcccgctggcgggagctgtccgcgaagcggactgagggtggtcatccgtacatggcgaccaccctcagtctcactccgttcgacagctcccaccagcgggagccagtgaatctaatcagcccttgatcttgcccatgacgaccttggtgacggccttggcgtcggcctgaccgcgcgtggccttcatcacggcaccgatgattacacccatcggcttcatgttgccgctcttgagcttctcgacaacgtccgggttggcttcgaacgccgcgtcgacggccgcctcgatggcaccgttgtcttcgacgatcttgtagtcgtgcttcttgacgacttcatccggagtgccttcgcccttaagcacgccttcgacggtctgcttggcgagcttgtcgttgagcttgccggaggcgatgagcttctcgacctcggccacatcggccggggtgatcggcagctcttcgagggacacacccttggcgttggcttcgcgggaaagctcgcccagccaccacttgcgggcaccggcagccttggcaccggccttgacggtttcctcaatcaggtcgagggcgtcggcgttgaggatgtcgcgcatctgcagatcactcaggccccactcggacttgaggcggttgcggcgctcgcgcggcatttccggcatctgggccttcatctcctcgatgtgctccttggtgatgtggagcatgacgaggtcggggtccgggaagtagcggtagtcgtcggcatcggacttcagacggccgccagcggtggtctgcgtagcctcatcccagtggcgggtctcctgcagaatctccttgccgtcgtccagacgagcggcctgacggcgaatctcgtactggatggtcttctcgatgccgcggaacgagttcacattcttggtctcggaacgggtgccgtacggagcgtccgggctcgggcgcaacgagacgttcacgtcagcgcgcatgttgccctgctccatacgagcgtgggagatgttcaacgcgcgcacgatgtcgcggatggcgcgcacataggcaccggcgatttcgggagcgcggtcgcccgccccctcgatcggcttggtgacgatctcaatcagcggcacaccggcacggttgtagtcgaccagcgagtggtcggcaccttcgatacggccgtcggcgccacccacgtgggtgttcttgccggcgtcgtcctcgatgtgcgcgcgctcgatcggcacgcggaacacggtgccgtcttccagctcgacgtccaggtagccgttgccgttggtgggcttgtcgtactgcgagatctggtagtcgcgcggcatgtccgggtagaagtagttcttacgggcgaactggctccactcggcgatttcgcagtgcagggccagacccagcttgatggcgtaatcgacggcggtcttgttgatcaccggcagagagcccggcaggccaaggctcaccggggtcagctcggtgttcggctcgccaccgaactcgatgtgggccgggcagaacagcttggtgttcgtggacagctccacgtgggtttccagaccgaagaccacatcgtacttcttggtggcatcggcgtacttcatcagtttttcagccatgatgttgtttctttccttccgatgctcacttgcccagaccgtcaagccacggggtcttgaggtcgttccagatcgggccgttccagctgtcttccagcgcggcttcgagggccgcggccggcttgtacatgacttcgtcgcgctgctgcggggcgatgaactggaagccgacgggcaggccgtcgtcggacaggccggccgggatggacatggcaggcacgccggcgaggttggccggaatggtggcgatgtcgttcatgtacatggccagcgggtcgtccatcttctcgccgaacttgaaggcggtggacgggctggtgggggccacgagcacgtcgacctgttcgaaggccttcttgaagtcttcgataatcagcgtgcggaccttctgggccgagccgtaccaggcgtcgtagtagccggcggacagggcgtaggtgccgaggatgatacggcgcttgacctcgtcgccgaagccggcttcacgggtgtaggccatcatgttggcggcggtctgcggcacgccggtcggcggcatcacgcgcaggccgtagcgcatgccatcgtaacgggccaggttggagctgacctcggacggcatgatgatgtagtaagcgcctagcgagtagccgatgtgcgggaccgagacctcaacgacctcggcacccatctccttgagcttgtcgacggcctcgttgaagcgggcctcgacgccgggctggaagccgtcgccgccgagttccttgatgaggccgaccttcatacccttcagatcgcgcttggcgccttcgcgggcggcggcgaccatcgggcgcgggccttcggggatggaggtggagtcacgcttgtcgtggccaccgatgatctcctgcagcagtgcggagtcgagcacggtgcgggagaccgggccgatctggtcgagcgaggaggccatggcgatggctccgaaacgggagacgccgccgtaggtgggtttgacgcccacggtgccggtcagggcgccgggctggcgaatcgagccaccagtgtcggtgccgagggcgatcggtgcctcgaatgcggcgactgcggaggcggagccaccaccggaaccgccgggcacgcgctcggtatcccacgggttgtgggtggtctggtaggcggagtgctcggtggaggagccctgggcgaattcgtcgaggttggtcttgccgagaatcggcatgccggcggccttgagcttttcgatgacggtggcgtcgtacggcggcacccagccttcgaggatcttggaggcggcggtggtttcgatgcccttggtgacgatcatgtccttgatggcgatcggcacaccagccagctcaggcagggcggccttgtcttcggcggacttggcgtcgaaggcgtcggcctgctcgagagccacatcgccggaaaccttcaggaaggccttgatggacggctcggcagcctcgatcaccttgaggtgggcttcgacgagctcgcgagaggtgacgtcgcccttcttgacggcagcggcctgctcggcagcagacagtttgacgagagttgcggtttcgttgctcatcgattactcctcgcttcccaggattcgcggtgccacgaacatgccggcctcggtcttcgggccaccggcgagcgcctcttcctgcgtgagcggggtttcggcgacgtccgggcgcaggtaggcttccagcggaaccgggttggcggtcggcggcacatcgtcggaggcgacttcctggaccttgttgatggagtctgcgatgacgttcagttcgccctgcagacgggtgatttcctcatcggtgagcgcgattcgggccagatcgcccaaatgcacgatttcttcgcgtgaaaatgttggcatggccataactatatgagccgtatgtgacacgcagttgtcgggaaaccgcattttcctaccctttgagaccatttcagcagggcaggcactcgggtcattatttgatatccgcttttctggtgacgatgagaccgccgatccatgcggcaggattgtcggcgcatggctacacgcctgatacggcgtgttgggcaatccatgcgtgcatggccacggccgccgcagcgcctgcattaatggagcgcacggaaccgaattgagagatgtagaccacatcgtcggccaatgcgagggccttctcgctcaatccggggccttctgcaccgaagagcagcaggcaccgcttggggaaggcataggcttccatcggcactgcgccgggaataatgtcgagggcgatgacgcgggcggcttgaagctccttgatgcgtgcatcacaagcatcgatttcggccagcagctcatgaaggtgcttgttgtctccatccacagccacatcatgcgcatggatggcggcggcaccggccttggctcgttcataggcgatttcaccggcgatgcgatgatgccagctttccaccagttcggcgatggaggggtggtgttcgacgtgctggtacagttcggtcatcaacgcgcccttgcgattccacttatgtggaccgacaatgtgtacgcgcttggcctggaaggcattagcggtgcggaccatggaaccgatgttaaaatcgtgggtccagttttccaccgcaacttcgaagtcgtgacgccctcgagcgtcaagatcggccttaatggcagcaacggtccagtagcggtaacggtccaatacgttgcggcggtctccgtcgttcaacagcaccgagtcgaaacggccgtcataattcgaagaagtcggatcatcgggacgaggctcaccgggatgggtctcagaccacggcccaaggccgatttcacggaattccggttcacctgaagctttggcagccaaagaaatctggttgggtgcgtgcaatctttctcctcgataacgctattcaccggttcctcttagtcagcttcgctgctcagcccggctgactttatgtgagggaagtcaaaggtggatttaccgcagttcggattcgtcgaagacctggatgaaggggagcgtttgctcgtcgccggtggaggggttgaccacattgatgtctttggcaccgccaccgaccagcgaggcgatggccacgaccttggcacccagctgctccactatgccaaagtcgaggctcagctcattgccgttgcgcagggtgaccagcgagctggtctgcacgtacgacttttcggacagccaagcatccaacagcaccacacggcggccttcgatggaggggcccttgatggacgggtagacgaagtccatcacgaatccatctaggccctcgccacgagaggcggcggcctggatcatggcagacaccatgggcacagatgctgcggtcaaggcaccaacagcatcgaagtcatcaatcgaatagcccgcatcttccaaagcgtcaatcagtacatggcccatgacagtggcggcacggtggtcgaaagtcaccgcggcaagttcggagaacggacggcccaccacatgctccttcagcaaggtggctagctgttcacgcggctccagcatggcaaagtcattatggctcttcgcgacggcaaggtccggggtaccagtggggcggaatccagattcagtcatgactccagactatcgcctgaggcagtcagatgagtatcaccttcatcggccggcaccacttcaggggcggacagttcgctcacattgcctttatctgattcgatgatcggtacttcctcgatgatcttggtcggttcgattttttgcagcttgcgagcggtgggcaacacacggcgttccaaactggacgcgaacttgttgtaggcgctgaccgtcttagtaatctgggtgcccaatttgatggcataatcacccagcgtggagaaccgttcgtacagttctcgggacaaatcgaacagctgcttggcgtcatcggtgagcgactgctgctgccaggcataggccacggatttcagcacggcccagagcgtgaccggcgaggtgagcgccactttgcgagagaacgcatcatccatcagtgtgggatcggcttcgagcgcggcctgcagtagtgcctcattggggatgaaggccaccacaaaatcaggtgctacatcaaaggcattccaataggccttttcgccgagagcacgtacatgctcgcgcaacgccttggcatgggaccgcagcaaatcatcgcggcgggcaatatcctcggggctggcggtgtccgggatttcgcaggcacgctggtaatcggcataaggcactttggcatcaatcggaatggtcttgcctcccggcagatgcacgatcatatccgggcgcaacgtacgcccatcggcatccgtgaccaccacctgggtgtcgaaatcgacatgttccagcaatccggcggactcgacaatgttcttgagctgggcctcgccccacgcgccacgcaccttgttgttgcgcaacgcggcggacaaggaactggtttccttgtccaaacgggcctgctgatcgttgagccccttgagttgggctcccaatgcgcccatttccctcttgcggccctcttcgatctgcgtgaccttgttctgcaaggtatcaagattcttggccactggcgcaagcgcctcgagcaccttgctctgttctttcaaacgtgcttcctgttcagcacgcttgacctcggcggcctgagcatccgcctgacgcttccgttctgcctccgcagctgcacgctcacgttcctgctgaatgcgaatctgctcagcctgctgcgcctgggcaagttgtgacttggcgaaagccaattgctggttcacgccttcaatctgagcttgcgcggcagcattgcgagcactgagctcagcgttctcgaatcgcgcattctccagcgaggtcttggcctcctccagctcctcgcttttgacgcctcgagccatctcctgacccttatgacggcctagcacgaagccggcgaagaggccaagccctgcaccaaccactagcacgacgatgacgataatcacggttcctatttgctcaaacatggtacccagtatgtcatcgatggtgaatgacggtaaaactcgtcacgatttgacgagacgcgcaatggccgcggaagcctccgcaagtttttcatcggccacctcgccgccctgaatcgacgcctgccgcacgcaatggttgagatgatcgtccagcagcaataacgccacggatttcagcgccgaattcgacgccgaaatctgcgtcaggatatcgatgcagtatttgtcatcctccaccatctgcgtgatggcacgcacctgtccttcgatacggcgcaatcgtgcgatgaccttggccttgtcttcgtcataaccatgcatcgcaaaccccctgatacttatccgtcagctgaacacaccccattatataccctctaggggtatagggtatacactgttgttcagtacaacaaacaaggggaaggaacggttatggagctcagcatcttctcggccgccacggcgctgatagcggcggccgcattgacatggctggtactgcggttcttcttcggaacgcagaaagccacggccggggccatggacgcctccggcgaacgccaatccgcaacaatcaccgtcaagggcgggtactcccccgccgtgatcagcatgcgcacgggtacgccgatcacgctgactttcgatcgacaggagaccggcgaatgcacttcgcatgtggtgttcgcggatctggggcttgacgccatgctgccgggcaacgccaccaccgacgtggaactaccggcgttgccggcgggcgaatacccgtttgcatgcggcatgaatatggtgcatgggttgttgagggttgagggagaggagagtaaggacggtgcggataaggacgggctgtgcccgcgtgctgacggctcggccgaagccgagggggtctctccctcagacttgcgggttggagctccggttgtggatgcggcggaggccgagcggcgagaggcggctgaacgcgccaatgagatcaaggcgctgacgaagctggtgattgtgggcgcggtactgacgttgccggtattcgccgtcaccatgctgcatatggccaatcccgcgctggtgccgcattggatggtgaacccgtggctgcaggccattctcatcacgccggtgatgttctactgcgggcgtccgatccacacggtcggcttccccgcgctggcgcaccgctcccccgacatgaactcgctggtctcgctgggcacttcggccgcctacctgtattcgctggtgacctgcatcgccccgtgggtgttcccggagggctcgcgcgagccgtatttcgaatcggtgggcgtggtcatcaccctggtgctggtcggccgcctgctggagaccaaggcccgcgaaggcaccggcaaggcggtgcagtcgcttatcagactgcgcccgcgcaccgcgcacaagctcaacgccacttccgcagacaatgtggacggcatcgaatggcgtaatccggcgcatttcacggacaccgacatcgacgccatcgccaccggcgacctgctggtcgtcaagaacggcgagcgcgtgcccacggacggcgtgatcgtggccggcgaggcgcgtatcgacgaatcgatgatcaccggcgaatccaagccggtctccaaaaccgcaggcgacccggtgaccggggccaccgtgctgctcaagggcggctgcgtgatgcgcgccacccaagtcggcgcggacacggtactctcgcagatcgcggcgatggtggcccgcgcccaggcgaccaaggcgccggtgcagcagctggccgataagatcgcccggtatttcgtgccggcggtgatgatcatcgccatctggacgttcgccatctggaggtcactgggcccggcgccgcaactggcgcacgcgctggtcaccgcggtcagtgtgctgatcatcgcctgcccgtgcgcgctgggactggccacgccgctgtcggtgacggtctcgctgggcttgggcgccaccaacggcgtgctggtcaccagtgccaaggcgctggaacaggcgcgtcgcatcggcaccgtggtgttcgacaagaccggcaccatcacgcgcggcgtggtggacgcggccgccgactgggacaagccgagctacgagcaggacacggtcaaggaaggctcgcgcgaggccatcgcggcgttgcgcgcacgcggcatccgcacggtgatgctgtcgggcgacaaggccgaggtagccgggcgcatcgcccgcgaagtcggcatcgatacggtgatctgcgaggtcaagccggacggcaaggcctactggatcgccaaactgcagcgcgaacgcgacgaggccaccgccaaatccgcgtacggcacctcccgcacggccgcgcaatcccgcactctgattgcgatggtgggcgacggcatcaacgacgcccccgcgctggcccaggcggatctcggcatcgccatcggcaccggcacggacgtggcgatgcagtcggcggacgtgaccttgatgagcggcgacttgcgcggcgtcatcaagaccatcaacctgtccaatgccacgatgcgcaacatccgcgagaatctggggtgggcgttcggctacaacgtcatcggcattccggtggccgccggcgtactctacccgttcaccggctggctgttgagcccgatgatcgcgggtctggcgatggcgttgagctcagtgtgcctggtgctgaacgcgaaccggctgcatggagcgaacatcaacgtgggtgctgccgatggtcccgccggttcgggcagcagcacggcggatgtcgaatcagccggatcggccgaatccgccaacgccgccaacatcaccggctccgccacatccaacgcgcctcacgagccgaccgtcatcatcgacgatcgcaccacgctgaatcaaaccaatcacgtatctgaccaatccaataatccaaccaacaaggagaacactatggatacgggaatgcacatgcaccacaccgcccccgcggacggcgaaaccgccaccgacccggtgtgcggcatgaccgtggctgtgaacgccgatgcaatcacgcgcgagtatgagggcaagtcctattacttctgcggcgaacactgtgccacgaacttcatgaaggccccgcaggtgttcctggagcagtagtctctgcgtttacctgattcaacgacaatggcctccgcccaaaacgagcggaggccatttgcatatatgaatcaatcaacgaatcagctggcgaagaagaacacgaacagccaagcgccgataatggcgccgacaatcggggccacaaccgggatccaggcctcgccccagcgggaggagcccttgtgcgggatcggcaggatggcgtgcagcagacgcggcatgaggtcgcgggccgggttcaggccagggccggtcgggccacccatggaggtcacgaggccccacacaatgaagccgacgacgatggaggcggcggcgtaatcctgcttgccccaagccagggacaggcagcacagggcgccgaagacgagcaccagggtgccgaacatctcgttgaggaagtagttgaccttctggttgtccgcgtcagtggtgcagaaggtgcccagaatcgcctcggcgtcctcggtctccttgtagtgcgggtagtaagtgatgtagacgatgagctggccgagcagggcgccgagcagctgggcgacgatgtacggcagcacgtcgctccacgggaacaggccgttgacggcctgggcgatggtcatggccgggttgatgtgcgcgccggagacgctaccgaacatgagcaccgggaacatgacgccgaagccgtagcccatggcgatgttcagccagccggcgtggtggcccttggtgttcttgagctcaacgttggccacggagccgttgccgaagatcatcagaatggcggtgccgaagaactcggcggccagcttggtaaagagaggataatccactgcttcttcttttctcttcgccgcgcaacaggcatggctgactgttcacggcattctgtgtgactggaaatccgttcgcggagccggcgacgcgatttacgctgggcgcgaaagcaaacgtggtgattgtacactttgccccacgacgaaatgccggcaagatgcgatgtcgaatgtccagccgaatgcaatgcccaaaaagccatcggaatcagccgaagcgaccttgaatctcagtggttgcgaatgacgttgcgcaggggcaggacgctggtgggcgagacggacagttcgtcgattcctaggcgcaggaacgtatcggtcaggctcaagtctgcgccaagctcgccgcagatgccgcaccagatgccatgacgatgggcagcctcgatagtcatctggatcatgcgcagcacagctggtgaatgcgggtcggcaaagcgttcgagactcgggttctgacggtcacaggccagcgtgtactgggtcaggtcgttggtgccgatggagaagaaatcgacttcggcggccagctcgtcggccataatgaccgacgcaggcgtctcaatcataacgccgatctggatactctcgttgaagtcgatgcgctcgccgcgcagctcgcttttggcttcttcaagaatccgcttggcgtcgcgtacctcctgcacagaggtgatcatgggcagcataatggcgatgttgccgtatgctgaggcgcgcaataatgcgcgtaactggactttgaaaatctccgggcgggtcaggcagatgcggattgcccggtaaccaagcgcgggattatcctcgtggctcagattgaagtagtcgacctgtttgtccgcgccgatgtcgagcgtacggatgatgaccggacggtcgcccatctcctgtgcgacttgtccgtatgcatcgaactgaaattcctcggtcggccagtcctcgcgttccagatacaggaactcactgcggaacaagccgatgccctcagcatcgttggccagcacggcggctgcgtcagagggacggctgatgttggcgtacaggtggacccgctgaccggacttggtttcggtgggcttgcccttgagcttccgcaggaggcttaggtgctcctcagcctcggccttcctgcgccggtattcggtcagcgtggcctcgtccgggtcgacgaataccgcaccgctggtgccgtcgattacggcaacgtgaccatcatcggccgggtcaaaggcgtcgccgatacctgtgatggcgggcaggcccatcgtgcgcgccagaatcgcggtgtgcgagttcgctgagcccttggcggtcacgaggcccaaaaccttagcgcggtcgagctgcgcggtatcgctgggagcaagatcttcggcgaagatgatgtggctttcgccgttctgcgcgatcccgttctgcacaataccgttctgcacagcatcgccttgtacactgccatcctgcgccgtgctatcgcgtttgccttgcagcacgttcatcacgcggcgagaaacatccttgacatcagcggctcgagcctgcatggtcgagctatccatcgcagcgaacatggcggcgaactgttcggcggcgctcttcaccgcgaattcggcgttcaccttgtcttgcgcaatcaaaccttcgacgcattccgcatagtccgggtcctggagcataagccgatgggcgtcgaacagttcggccttgttttcgccgaactcagcggcgacgttgtcacgcagttgcttgagctgagcgacggccgtgtcacgggccgcgcggaatcgatccatctcggcctgcgggtcgtcgattaagcggcgttctacggcataatctacggcggcgagcacgcggaccgtgccgatagcaatgccagcggatacgctgacgccctgtatcgttctcattacaggtgctccttgaggaatcgctcgaactctgcagcagcgacagcttcatcgttgccctgcacccgaaccgtaacctcgtcaccttgttgaacatcaagtcccataacaccgaagatacgcttggcatccacggattttccaccgtaggcaacggtgatgctcgattcatattcctgcgctttggcaaccaaccggccagccgggcgggcgtgcatgccttcggggtcggatacggtgaacgtgaatatctgaggcatgacgttgctccttacacgtccggccgtcacgcgcgaagacggcctttccgcaccagctacggactgatactggaaaaaacaaaaaaaccggaatctttcgattccggttgtctgtgcccccgcagggattcgaaccctggacacgctgattaagagtcagctgctctaaccaactgagctacaggggcttggttagatgttgaagtattccttgcaacaggtgataaatatactcagatttgaagcgaatgcaactctcggcgtgtcgcgcctatttccggcgttttttgctaatacaaaaatcccccatgcggcgcgaaccgcacgggggatgatgcttaagctcagactcttggtctgtgtgattccagcactaggccggaatgactcactcggccacgaccttcacgaagaaggaagcggtgatctccgggtggagggccaccttggcggggaaatcgccggtggtcttgatggtctcgacctcgatggccttcgggttcaccgcagccttgtcggacagagcgacggcgatggcctcgttggagataccaccgaacagcttgccggactcggacaccttggcggcgatctcgacggtagtgccctcgatggcggccttagcggcgacggcgtcctcgcgggtagcgacggccttggccagacgagcgcgcttcatagcgacgatctgagcctcagcgcccttggtccacgcgaaagcgaggccctgcgggaacaggtagttgcgggcgtagccggacttcacgtcgacaacgtcaccggaatggcccaggttggacacggtcttggtgagaataaccttggtttcagccattgttcaaagcctccctaactcagcgacccgaggtggcgtacggcagcagggccatctcgcgggcgttcttgatcgccttggacagctcacgctgctcctgcacggtcacgccggtgatacgacgggaacggatcttgccgcgatcggaaatgaacttacgcagcagcgcaacgtccttgtaatcgatctcggtgaccttggcggccttcagcgggttcggcttcttcttgaacggcttgaccggcggttgcggcctcttacgtgacatgatgttctccttataaatcttgatattgattgctgctggcagcggggaggcaagtactgatcagaactccgggtcggaatcgtcgccgccgaaatcggaggaagcgccgaacgtggagaagctaccggcatcagatgcaccggcattactccacgggtcgaccgcaggagcggacgggttggcgggagcggcagactgctgggagtatccagcgccaccaccctgatagccaccgttgtaaccgccctggccaccggcataaccaccttggccaccctggttgccatagccctgattgggctgctgaccaccctggaaaccaccggaacgaccctggaagccgccctgaccggacgactggcgagtcacctgtgcggtggcgtagcgcagggagggcccgatttcatcgagctgcatctccacgacggttcgctgggaaccatcctgtgcctgataggaacgctgctggaggcgaccggtggcaatcacgcgcatgcccttcttcagggactgggcgcagtggtcggccagatcacgccaagcggagcacctcatgaacagcgcctgaccatcctcgaactggttggtctgacgattccaggttcgcggggtggaagcaatcgtgaagctcgccacggtcgcaccgctgccaatagtgcgcagctcggggtccgcagtgaggttgcccacgatggtgatgacggtttcgcctgccataacggtccttcttacttaccttgaataccagctgttcagctgactaaacgcttgattcagcccttacgaagaatcttcgtacgaatcacggattcgttgaggttcagaacacggtcaagctcatcgctggtagcgggctcggcggtgtacttcaccacgacgtagttgccttcggtcttaccggcaatctcataggcgagcttgcgacggccccagtaatcgggctcatcgaaagagccgccttccttggtgacgagttccagatactgctcggtcagcttcttcagaccgcgctcatccagctcaggatcggcgatgaacatcagttcgtacttgtgcgcagacatcacccacctccttcggactattcggccacggacgttccgtggcaggagtgtgtatgcgtgttaatcatagggcgatgcagatgcacttcaccctgtgagcaacttgcctatcctatggtcagggcgggacagtgccgcatgttcatcaacgattgcagcactcttacaacacagccccacttcacggcacgcgctgcggcggggtgcttgtacactggttaaggcgtaaatcacacagcgactcaaacaaaggatgcgaacgcatgtcggcgattcttgaaggcactccggataaacgactcgtattggtcacgggccgcgcctaccccgagctagctgagaaggtggccgaatgcttgggaaccgaaatcctcgaaaccacgtcctatgactttgccaatggcgagatgtacgtgcgtttcaccgaaccggtgcgcggtgcggacgtgttcgtgctgcagtgtcattcgggcgatatcaacaagtggatcatggaacagctcatcatgatcgatgctttgaagcgcgcctccgccaagtcgattaccgtggtggcgcccttcctcggctactcgcgccaggataagaagcaccgcggtcgtgagcccatcaccgcccgtctgattttcgatctgttccacgccgccggtgcagaccgcattatgacggtcgatctgcacgccgctcaggagcagggtttcttcgatggtccggtcgatcatctaaccgccatgccggtgctgctcgattacgtgcgttccacccttgatctgggcaacaccaccatcgtgtccccggatgccggccgtatcaaagtgtccgaacagtgggccgccaagctaggcaatctgccgctggcattcatccacaaacagcgtgatattactcgtccgaaccatgccgaggcacatggcattatcggcgatgtcgacggccgcgactgcgtggtcatcgacgacatggtcgataccgccggtactatctgcgaagccgtgcgcaccctgaacgaatccggcgccaagtcggtgacgctggtcgccacccatggcctgctctccggcccggccgtggagcgcctgtctcactgcggcgcgcatgaaatcgtgtttatggacaccgtgccgattcccgaagagaagcgcctgccgaatatgaccgtactgtcttgcgcaccgctgctggccgcgggtattcgctccgtgttcgaggaaggttccgtggcgattctgctcgacggcctgcccgaggacatgcgtccgcgcaatatctatgcgtgattgatacgccgaaaatccttacgaaaaaaacgccgcttggctatcaagcggcgttttttcgtatagctccaatcagatgaaggcgcgttcgccgaagatggcggtgccgacgcgcacgatggtggagccctcttcaatggcgtaggtcatgtcgtgggtcatgcccatggacagttcggtgcagtcggccgtgccttcggcaccggaggcaagaatctggtcacgagtgcggcgcagatgcgcgaagcccgcacgaatcgtgcgctcatcatccacatgagcgccaatagtcatcaatccctgcaagcgcagtccgcccatcgcaccgatgcgctgggccaagtcgatggcgtggctgggtgcgcagccggacttcgatccctcgccggattcgttcacctccagcaacacgccgaccgtgatgccgcgcatggtggcacggcgggcgatcttttccgccagttcgatggaatccacggattcgatggtgtccactaccggcagcaccttgccgattttattggcttgcaattggccgatgagatggaaaggaatatgcgttgcagctgcggcattggccgtgtcagcctcagcggcatcaatcacgcctagcgaataaccacgctcccccagtcgttttgccagaccgtcagccttgacagtaatctcctgtggacgattctcaccaatcacgcgaataccagcatcgatagccgccagaatctcgccgacatcgcgcgtcttggtggcagccagcaattggaccgaaccggcagcacgcccggctgcggactccgctgaggcaatccggtcaagcacgcgatgcacaccaccagtaatctcttgtgcgcgcgcctgatcgataacttcgttggcgagatccttatggtccatgtatgccgtcattgctgcccctgttcgtagattccccaccatcgtagtctcatacgcgcacataatgcttgttattgaacaaaagtgaagcccccgctgttcatgcgcgggggcttggtgatgctaggccgagcgagtgggactagcaggtaccggacttgcggcgcttgaggatgattacacccgcaacagcaagtaccacggcgaggatgccaacaccaagcacggctgcaccggtgtcaggtatcttcttgtgcttgccggagtctgcatcacccttgttctggttggaatcgttgccttggttgggcttgtccgtgccggaaccgggcttatcgccaccctggccaggcttcgtggtgctcttctcaaccagacccgcgatggcatcgctgattgcctcagtcgcagcctgtacgtcagactgggcggcctgaccatcactcgtcagcgcattcgccgtagcgactgccgaatcaagcacggccagcgattcatcagtccactttgtgcgatccacggcagcagcggcatcgagctgagcgctcagcgcggcacgatcttgcaccgtagctacaagcaccagcttcttcgctgcctgcttcagctgggttgcggcatccaccaccgcagcttcggtggcatcctcagccttatacacctgctgcgccgaatccaataccgccgcgtactccgcccatgaagtctcggtgtacttggaggcatcgtcagccttaggcgagtcagcgagcgcctgcttgagctcggtcttgtcgatcggtgtgggctcaggcggctcaggcgtactgtcgtcaatggcatgaacctgccattcggcaacagccggagaagccgagccggacgtgataaccatacgcaacttggtagtcttgaccggagtgttccacgtgccatcagaccaccccttggcatcgccggtggcccagccagcagacggtgaattggcggtcacagtgtaggtggcgtcggaaatatccacgaagttgccggcaccgttgttcgccaaggcgtcccagtactgcaattcccacgatgccggaatacccaatccgccatcatccgaggtgaattgcacgcggctagagtcgatagtcacttcacggtcccactcgtagtcgaggcgcatctcaccggtgttgggccaagtgccccagacatcctcgttggcaatggtgatatcgggaatgatcttgccgtcgttcaacgcggcggcacccttgacccagccggatgccttgccgtccacatcggtggcggtggcatcgccctcaatgtagccggtcagcggcacggaagtgtcggatggaatgtcggttttcgccgaagcggacacgttgccggccttatcggtggcgcggtagtacacggtggcgcgcgacgcgctcggtgcagcaatcggcttgctgtacgtggcccattgaccgtctgtgccaatgcggtattcaattgatgcgacaccggaaccggtgccgtcatcagcggtcaaggtcagcgtgcgctcctccttatcggcggcggcggtcacggttggcgcggcggagtccaccttgccgccggccttggccacgtcggaaacgttgccggcctgatcggtggcgcgagcccacacttcgacatcgccctgctgggaaagcgtggcaatggccgcgtttgcattcgcggcgatggtggtccagctcttgccttgatcagcggaaatctccagcttggcgataggtgcggtgtcgtccgtggcctgcacggtggcgaacggagcggtggtgagccactcgctattgcctgcgttagcagtaacggcaacggttacagtcggcttcgtggtatcagcggcaggctggtagccgtcctgcacggtgacatttaccgacacattgccctgctcgcttgcctcaccgggcacgccggcgaccacgccgtaggccgtaaacgaaccgaccttggcatacgaggaagcatcaactggacgccaaattactggggaggcaacggttgggttcccgtacttcacatccactgtggccggcagagtaggcgcagtaccggtggcggtggtcacgctcttcggcgcagtgattgccggcgattcgctggagtcggagccgacttcccattcagcaacggccacggaggcatagccgccatccacagcttgaccggtcatgtcgagctttaaggcagtagtggtcaccgcatcgaaggtgacggcgttggggttggccttgcctgtggtcgttgtataggcactcgggttggtgacatccttccatgtgccgtccgcgtccaagtactgaatcttccacgaggcgggcgcgcgcagagcgttggaatccacgtcgaaccaaaccttagacgagttgacgcgcacagtgccatcccattggtagaccagagaatcgccggactgcgattgcgggatagaacggtagttggtccagtgattcggcgggaccacagcggtttgcaacacacggccgtcgttcaccgaacccttccaagcaggcgtttcagtgaacgtggcgctcacctttgcgtacggagccacgttggtggagggctgcgttttctcggccttggttggatgggcggtggaaaccatctggccgtcggcggtccaatcgacttcatcaatgcacacggcacggcggaaatcggtgccgccttccttgtcgccggtgtgataggtcacataccatttgtcgccgaactggagcaccgaggggtgcatcgtggtggccgagccagaaggcacgattacgccttggtacttccatgggccgagcgggctgtcggaagtggagtactggatgcaagcttgatagttcgattccacgcaggtggccgtgcccgaaccgggcttaccgccgtcgtacacgttgtaataggtatcgcccttacggaacacccacgccgcctcgaagaatcccttcgggccgttcgcgttgctgtccgcgtccttcatggtgtggaggttcggcgtggtgccatcagccttggtttccacctcggtgtatgaggtgcggccggttgtggcgtccttcttcatcttgatggcgagctgagtgccgaacgtaccaaagtgcaaatatccggtgccatcctcgtccacaaagaatgccggatcgatggtttcaatctgggtttgcgatgtggtgagcagcggcttgccgatggcatccttccacgggccgagcggactcttcgacttggccacgccgatggcgaacgggtcctgtccagccgcctcagaagccttgtccttcaccggcacgtagtagtagaaccaatcatcggaagtgtcgctcggggtgccgttatcgtcggctacgacttggccggcgtacgcgccatcgccggtggcccagctgaacaggtctgccttggcgatggtcttgtaatgtgtccatttgccttgattcaggccgtcttcatcggtgacgtatacgccccagtccttcatgttgaaggagccgtagtcgggcgaagcctcatcgtgaccggtgaagacgaagagtttgccgtcatagctcagcgcggatgcatctgcagagtagtagttctgcgaaagatcgttcggggtgtcaataccctcgttctgcccgatggggttgcgcatgtagctgggcagtgcgctattgtcgatttgggtgacggtgacatcaggattgttatacggcagttcgttatacgcgtgaccggcaacgctgggcgcgttgtcagcggtggctgaatcggcggccattgcggtcggcgcaagggcaaggcctgacagcaatgtcgctgcggcgacgagtccaccggccaccgcgcgaaccgattgcgcggatacatggaaactcatagtgctcctcattgagtgagtgaaaagagtaatgatgggtagaaggaaaaggctagagccccctctgtgagggggctcactcggcagaatgactccgttgcgggtcaggccgagtggcgagccgaaccgtggtcgccggactggcgacgcttcaggatggtcacgcctgcggcggtgagcagcacggcagccgcagcaactacggaaaccgcggcaccagtcggaggcacacgatcacccttgttgtccttatcatccttatcagtgtcggtcacaccaggctgctgggagccgggcttctgctcaaccttggtggcccaaaatgccttgtcaagggcatcctgtgcggcatcgacatcggcctgcttggcatccttgtcgtcgtacaccttctgagcggcggcaatctggctctgcagagcctgccatgcctcctcggtgtacttcgacttgtcagccttcttggcctgctcgatggaagcctcgagggactccttcttcaccgtttcggcggcgggcttctcttccaaggccttgacggccttgttcagcgaagcggacgcttcctggacggcggcctgagtgacctcaccgacctcaccgaccttgagcacaccttccgcagcctcgatggccttgttcaaggcctcgacactcttatccgtgtacttgccggaagcggcctcggctttggccgcatcgatggccgcctgcaacgtggacttctccacgtcggtggcgagcgcaacgagtgccttctggccgtcctcgagcttggtcacctgctcggcgacctgttcttcggtggcgttggcatcgtcgtacacagcctgggcagcgtcaatgatttgctggaactcagcccatgaagcggcggtgtagcggcgtgcatcgaggccgttggctgtgtcaagagccgactcgagcgcggtcttgtcgaccggggtaggttcaggctcggtgccgtcaataccatgcacgccccactcggccacggcggccccgaaggtgctgctgccggtgtgcggagtgagcacgagtcgcagcgacttggtggcgaccggcttgaaggtcacagtgctccaacctttggcatcggtatccgcacgagaagccggcgagttacgcacaatggtgtaatcctcggtgggctcgacatccttccaagaaccatcctcggcgaggtactgaatcttccaagcgtccgggacttccagaccacccttcgaatcgtcagtctcagcgaagttggcccagaactgggcgcggctctggtcaacggtcacggactgaccgaagtcgtactgggcgtacatgccgtcctttgccttgccccaagaaccccagaccttgtcgttgacgttctgatcatccgtggtcggccaagtatcatcgacgactacgccgtcgttgagcttgccttcggccggtgaccaggtcgcctcggaatcaggcgaaatggtggtcttggtcgccttgccttcaatccaaccgaccaacggctcaggctcaggctcaggagtggaggaaccgttcgggtcggcaaccacgtggacagtgagcttggcagctgcggaagacgaaccgtcgtcgacggtaccagccacctcgtagtcaccaaccttggtcaggtcgatggccttgatgtcggcatccttccacgtgaccttgcggtcgtcgttgtatccgttcgggaacttcaccggaaccgtggcgggcaggtcgatggacttggcgttctggtagacggtctgctcaaccggctgcgcattacccacggtctgcaatgcggtatcggaacgagctgcgatgtgtgcaaccgtaccgctcagcgcaccagcgacgatgcccttgacatcgaatacggcatcggcggccagctgagcgtcggtcaccttatcccacgtgacggcgaggtcacggcgagaaccgtcggtgtatacggcgctcacggtggagggcagcttcagatcatcggccttggaaccggtctgcaccagtcggttgacttcgtccacgctcaccggctcgatggcgtacgcctcgaactcggaagcacccacgatggcgcccttcgggaagaccacgcgcagcttgtcggtttcgacggtgtcggcgaacttcacttcgttgccttcgttctgattgaccgtgtaggactggccgtcagccagcttcacatcctgccagttaccgtcagcgtcagcgtactggagcttccaagatgaggccatcggcacgccaccgccatcggtccagaagaagaccttggccttcttcagtggcaccttgccggcccacttcagttgcagccacggctccacaccagtgttgtcgccccagttgttccaggtctcgttcggcgtgttggtgtataccacctgaccgtcgatgaccttcttggcgttgtccttcggctggtagccgttggtgtagctggcagaggcgctcgactgcggggctacgttcacggtaccgtcagaggggatgccgtgaacggtgatttccttggagccttccttctcgccatcggaagcggtgagcttcagaacgtagtcgccttccttgttgaaggtgacggtggtgctggcagcagtatcgtccacgaacttcgcggtaccgccctcggggccggaaaccagctcccacttggtggtgacgtcgccttctgcgggcagaccgtcatccttcaccgtaccgacgagcttggcaccagatgaggtgctggaagacacgtaagcatccacctgcggagtctggttctcggaagtgccgtcagccttgataccggtgttgtaggcttcgatctccttgacaccgacggccatgccggcctgcggcgtgaaggtgacgcggatggtcgtggtctccaccggagtgaactggatacggttgtagttcgcgcccgcgtagttcggggtgcgcacctgatccgcaatcggggcccatgtgccgtcatccttctggtactccaacttgtagttggcgggctcggcatagccggagatggtctggctggacgagctctggtagaagtacaagcggatgtcgtcgatcttctgcttgccgtccttgaacttgatattgagcgtgtcggtcttgttctcagagcccttggtaccccagaacgattccatcacggtcttgccgtccaccgcgttcttggccgggtagttggtgtccttctcggcgtaggtggtaccggtcacgtccgcgtccttggccacgttcgtggtggacttggaggcggagtcgacgttggtgccggacttggcgaacaggtcggtcacgcgctgatcggcattgaaggtaacctgattggcggccttgatatcagaaccagcggcattggtgatggttacgccggccttgtcggcatcctcaacggtgcccgtggacggatcgtaaatgaggtgtgcgagcttgtcggaagtgaaggcgagcttgccccccacgtacaggctgtagccagcaggtccaccatagtggctgccgtccttatcccacacgatggaaacatcttgaccgtggtagctcaggttgtttaccgtgaagtagttccaaccggggatttcgatcgggtttagctcaatcttgttgtcctcgcgcggcaccataccggctacgtcctcgaccatcgtccagttcgtggtgccgagctgggtgtggtggatccaggagcggtaggtgatcttgccgccgttctgtgcggcgtcaaggttcttgtcgaggttgttgatcacgccgtcaccgtttacatcgccgacgttgttgttatcctcgttccagaactcgttctgatcaaggtagttgttatcgccgccctgatagtgcgcgaacgccacccagtacagcagcttcttgaactgctcattggtgatgtagccattcttggctgcatcgtagttgcgaataccggccgagtagacctgcagcagcggctgcgcattaatgatggagaagttgttggaaccggggaagttcagcgccgccttgtccgcttggttggcggtgaagaacgggaagatcgggaactcgttggaatcctcgaacaggcgcagagccttgttgtaatcttcgttgccggtaggcatcaggccttcggagtacgggtagtagttattgatctccttgtacttggcgaaagcaccgtcgttcagccacttgtgcttgagcaggttgtcggacttgtcccacagttcagtggtgacttctttctggatcttgtcggcgatggcctgcatcttctcggcgttggcggtatcgccagcggccttgtaggcctgagcagccgcattggcgttggcccacatattggcggaaccatcggcgcgatccatgcgctggccggagcgacccggctcagagaaggaaacggcgtcggcatcgttaccggtcatcgaccaccaggaccagtcaatcaagctgttgtcattgttgttctggttgtcgttgttgtccggctcgctcttggaagcgagtagaccttgcacgtcctcggcaccctggtcggccagctcctcggccacggtggacggaccgccgtgcaccttgtaggagtcccagccggcgcgcgtgatgtactgcgtgtagctatggttccagttggccgggtcgcccggattgtcgtggtagtagtaatagcccgccttgctcttcttggcggtatcgccggcggaaagccaggtgccgtaggagtactcggggttgcggaaccacttggtgtccatcatgaacatgccggaggtgagcacgatttggttgttgtagccgagcacaccctcgatggaggtcgggtactggaaggtgttgccaggcatgttggcgtcgagcatgttgaaacggctcagccaccagcggtagaccacggtcttatcgatattgtcttccggagtgtccacgtagggagcgttatcgacccaccacttgttgtaggtggtcacggaatccttgtaggaggcggcagcatccttaaggtcgccggtgtaacgggcctcatattccttggtggagtcaggcagttcgttggcgatcaggccgagctgaatcttgacggtctgcggttcgttggccttgaggctcaacgtgctggtgagtttgccaccgctgacgatccagttggaaccgtcctggttgttggcggagaagcgcggatagatggtcgtcaggttgttcttgacgttcacgcggccagtaagttcggtggcaccatcagcaccctcggcggcgaacggcgaggccgtggtcagtgtgacatcgcggtcctgcgtgctttccacggtgaggttcgcaaccatcacgttgttgtaggtgatgtacttgacttccttgatcttgaggctcttgccaccggtctggaacagggaggtgaagtagctcggcgtctgcttgcgctgggaggcgtcttcgttaagggtctggtttgatccatcagcgtttacggtaacggtgaagccgctcctgctgatctggtcccagtaggcggtatcacccacaaaaccgagctgattaggcgtgtgcgtgtacatgtaggcggcgcgaccacgggtgaacaggtagttgttgccgtcggagccttcatacgagtaagcacccttgtcgttcgtgcctttaccagttggctgtgcaccagtacgggtgagaatcttatcgatccagaagtcatggtcggtgtcgatgccggccaggttcttcacgtcgttatcgaatgtctcctgcagatagctgacggcagggttatatgtggtgttgttcgccgccgtcttcatcggatcatcagatcccttgaacgacggatatgccacatccgcattcttgatgacgggcgcatcggctgcctgcgcggtgactgcaccgccggtggccagtgtggcgaccgctgcaaccgcgccgattgacgcaagccaccgctttcgtgttgattgatgcattcctgcttggacctctccgccccggtctttcgcgtcttcgctcaggctacgtcgcatctatgcgaccaggacttcttctgtggatgctgggccgcagagcccgttctccgtcagtttcctttattggctattgggttcaccggaatgagtatcttcagtgaatctggtgtgatatccgccatggatatcccggttggagcaattcaccgaagctgattccagatcataaccgagcgaatacggtttcgcaactttccctcagcgatatcaaccatcttatacaacaaaaacccggtaatttctcagctttcgcatttattttcgcattagagcattgctgcgtttcgccgtgtcgcagtacctacggcgcaacgattcagcctcgctgaatcaggaaccaacaggctcccgctggcgggagctggctcgcaaagcgagactgagggtggcttacacggtaccgcttatgaccgccctcagtcgactccgccgacagctctcacagcaggagcatataattaaaaaataatctcctgcacgggtattaccccgcacaggagacctcattccccggatgtgttttcggctccaatcgatactgacatccggcctatgccgtcatcgacttattacagacgatggcggcataagtatttttttgccggccagttgcgcgcaggccggcatatcgccgatatttatcgacgctggaagacacgcatctcgcctatctcgcggttggcccacgagtagtacggcaccaagcgcagcgtcgcgggttcgcccgcacgcggttcgtcggcatccacgtacagcggcgcgtcatcctcgtcggcgtgctcgcgcactgccggcaaatcaacggtatcgactccacccagcaagtcggtctggaaagccacagcggcatccgcaccggtgacgccatcggccagacgatagttccacaaatcaccgggattatcgacctgttcggcgcagtagaccagcggtccgcgcatcacggccacctgaccggcatcggagcgcacgcgggagttggcgcgcacgaacttcacggacatgtcgagctcgagcgcaatctccaacgtatcgccggcgttgaccacaaggtatacgaagccgtcttccagcgagcccactgcgggcttgccgttcacggtcagcgtgtaggagccccgcgaccaaccggggatgcgcagtccgaaacggaccgagctgtcagtggcgctggcgggcaggctcaccgtgtattccacatggccatcccacgggaagttcgaacgctgctcgaccgtcaggccggaagcgaattcggctgtgttggcgatgaactggtggctcagcacggtcttgccgccgtcgcgctcggtgtagatgtagcggtccacggaggcgatgagtcgggcgatgttggccgggcagcaggcgcagccgaaccagtcgacgcggtgggagagcacgtggtggcggtccgggttatccagtccgtcaggcgtggtctccagtgcattgacgtagtagtactgcttgccgtcgagcgagatgccggcaatggaaccgttgaacagttccttctccagcacgtcggcgtattcgcccttgggctcgaggtcgagcatctgctgggcgaacatgctcatagccacggaagcacaggtctcaccgtacatcgtgtcgttcggcagatcatagtcgtaggtgaacgactcgcccacgtgggtggaaccaatcgcgccggtgacatacatacgacgggtgacgatgttcttccagaaacgcttggcggtgtcgatcagtccccgatcgccgagcagtcggcccacatgggccacaccagtgcacaggtagccgacgcgcacggcgtggccatccgcggtctgctggtcgcgcacaggttcggcggcctggaagtaggtgggcttgtagaagccgagatcatggaagatgttgtcgccgttcatcgccttgagctgcttggcgtagaactgcggatcctgaccgcgcacgtcgatgagatactgggaaagcgtcagataacgcttctcaccggtctcttcatacagcttggcgagggcgagttcgatttccgggtggccgtcggcgccatgaatcttgccttcttcgggaccgaagttggcatccaggcagtcggccatcttcttggcgacttcaagggcctgctcgttgccggtcacctgatggtaggcgacggcggcctcgatgtagtgacccatcacgtacatctcgtggctctgctgaatcaggctgaagcgcgggcggtcggcccatacgccggacttgatctggtacggggtgtccaaatagccgtccgactgctgggcgcgggcgatgagatcgaccgtgcggtcgcacagcgccttgagctcgggatccgggtggtatgccaatgcgtaggcggcttcctcaagccacttgtagacgtcggagtcttggaagaccatgccatggaactcgtcgtccaattcgccggcggcaaccttcaggttggcaaccgcatggctcttgttgtcagccagctggttgccggctgggtcgtcgggcaccgtggtgtcgatctcgtcgttcatcacgccccactggtaggggatgacggattcgacgatctggtcgcgacgccgcttccagaacggggaagtgattgtaacgttcatgattgtccttttttaaggcccttgaccacaccgcctccggccctgcaattaaggaccggtttcagccgggctcagtattggcttcgacgctgtcgcgtctcagcacggagcttgctgggagcccaccgggctcccagccaagggccggcggcacgagccgtcagcccttgacagctccggccataaagcccttgacgtagtacttctggagtgcgaggaacaggatggcgcagggaatcagcaggatcacgacgccggcctcggtggcaccgtaatcgatgacgcccatggtctgctgacgcatgttcaccatcgccagcggcagcgtggacttggacgaagagctcaagtacagcggaatcatgaagttgttccatgcctcgaggaaggcgagcaggccaaccgtaaccatcgaaggcttgaccaccggcaccaggatcttgaacaaggcctggaggctgttgcagccgtcgaccatggcggcctcctccatgtccttggggatcgcgtcgaacgcgttgcgcatgatgaacgtgctcataggcagctggaacagggtgatgaccaggcccacgcccagcaggctgtcgttcaggccgatctgcttgtaccagaccatcagcgggatcagcagcgaggcgtacggtaccatcaggatcgacagggtgaccatgaagccgaggttgcggcccgggtagtcgaagcgggagaacgagtagccggccagcgtacagacgaccacggagaacacgaccgcgaccagagtcacgattaccgagttgaacaggtacttgggcagaccttcctgataaccgaacagggtcaggtagttggccacgccccagcccttggactgggccgaaccggcctgcgggctgaacgagcagatgatgacccagaccagcgggctgatgaagatgatggccagcagggcctcaaggatccgggcgatgatacgcttccacaatggggtagtcataatgtgttacctcccctttctcacttggtgttgtcgcgcatgccgcgcatctggatggagttgatgatgaccaaggccaccagcacgatcagcgagagcgccgcggccatacccagatccttcttggaatcgaaggcgaagttgtagatgagctgcaccacggtcatggtggagttgttcggaccacccttggtcagaatgaagaactgatcgaacgcgaggatcgagccggtcacgcagtagaccaggcacatcacgatggtcggcttcatcagcggcagggtgatggagcggaagatacgccaggaaccggcgccgtccatgcgggccgcctcgtacagatcaccggggatggcctgcagaccgatcatcatcagcagcatgtagtagcccgagaaacgccaaacaatcacgataatcgtggcccacagggccgactggccggtggccagcaccgaaccaccctcctgcatcaggcccaacgagctcagaatcttggtgacagggcccacctgcggggaatacagggcgtagaacagcagggacgcggacgccaggcccgtcgcggacggcagcaggaagcaggtacgcagcacgttgttccacttcgagctctcctgcacaatcatggccatgcccaggccaaggaccaacaggaagatcgtgacgatcacggtgtactcgagcgtgaaccaaatcgagggccagaacaatttgttctcgaacaccttgacgaagttgtccgggaagttcacgccgcggttgccacccagcaggctccaacgagagcaggccatgacgaccagtagaacaatcggcacgaagaacaggacgataatcatcagccagtccggaagtgcgtacagcagacctcgcctggtctgcgccgccttcgccttggacttatgcacgggcacagccccggcgctcttggaaacactcgacatgtttctctctcctttgggaaattactgtgaaatggtaatcacggaatccgaatgcaatccgatgtcagggcttcgaggaaggaggactccgaagccccgccaacacaccgcattcataaggtatgtagtgatgaaggaagaaaaggaatgaagaagaagatagaagttcgattatgtggttgagccggctcctgccctcacaagggagggaccggctcaatctgttcagttgttattcagttattgctgtgatttgatgagtgatggtgaggagcatcaccaccgaatcactgggcagacaggacgtcggtgacggccttgttgtcggccttgaggtcaccggaaccccacacggcgttctgcacgagcagctgccacggggagccagcggcgttgaaggcttcgttgaaggccggggacttcggggtctggccgttgccgtcgataatcacggagttgatggtctggatgcgtgggtcagcgtctttgtaagcggtcttcagggtctggatgttggaggcagtgtcgccttggtcagcgaagacttccttctgagcgtcagactgcatcagccagtagaggaagttccaggcctgagcaacgtgcttggagtccttggagatacccatggcatcgccgccgaggaacgtggaggtcttgccttccttggtgcccgggatcggagcaacgccgacctcgaagccgccgtccttctcagcatcgaacagagcagtggtggaggtgttcgggtaaggcataacgccgatcttgccgttcgcgaacggagcggtccaggtggcgccggtctcttccttggagcctgcacccaggccgttggtggtgttggccagctccttgtaagcgtccaagacgcccttcatggagtcgttgtccagggtggcctcggagccatccttgttcatgacggattcgccgtcagcccacacggacgggaagaggtcgaagaccagagcaccaccggactgaccggcaaggtaggaaccggcaacgccatccttgttgagggcggcgaccttcttggcctgctcggtgaactcagcgatggacttcgggccctgctccggatccaggccagcttccttgtacagggtcttgttccagaccatcacggaaacatcggtgatgaacggcagggtgtactcggcgccgtcaacagtaccggcttcgatgtggccctgctgcaggtcggccttgttatccaggccatcgatttgcttggtgatgtcggtgaagatgccctcggaagcccagtacggaatacggaccacgtcgccggcgaggatgtcaggcagggagtcggtctgcgaagcgccgccgaccttgccttccatatcgtcgttcgggatgatctcgagcttgacctggttcttgtggctcttgttgtaagcctcgaccacgttcttggcctgacgctccagaggggaacgggtccacagggtgatctcggtaccatcgtcggtgcccttggccgggataccttcggcggtggcagtgccaccattgccggagccaccacaggcggccagcggaacgatcaacgcggcggcagcgatgccagcaagagtacgggtcagtttattgaaagacaccatgttcgcttctttctctatatatccgctcaactatgagaggcggtggcggacggtccgcctccttggtttcgccctgctcgctcctttgctcggagcaggtaacactgcgaaagccttttctcaatataaacgaacatggaagtttttgcaaaagcgctttcgcattttcgcgttttttctcacatcaaacgggttcgagactgtgattcgactatgaataacgtgcttgaattggcttaatatcaatgattattccggcgtgtcgagcaaatcaaacaaaagcgaacatggaagtaacgctttctttcacttaccttgcacttgaacaatttccctgactacgccacgccgaaaaaaagatgtttgcgaaagttttcgcattgaagctacaattattcccagatgtaatggcgcaccacaccgtatgaggtatttcatcgcaaaacaatgcgctatatactgctgaagaaccaaggaatcgaggcatgatgacccagccagcaaccggacgggcagcgcgacttgaggatgtggcggcattggccggagtctcgacggccactgcatccaaggcactgcacaacaaaccccgcatcagcgaagaaaccaagcagcgtgtactggatgccgccaagcaactcaactactctcccaacaaactcgcccaatccctagcccgcggcaccaccggcactatcggcctggtcacctccgatctgcagggtcgtttctccacaccgattcttatcggcgcggagaacgagttgcgagcccaatcgacctcagtattgttggccaacgctcgtggcgacgccgccttggaacgtcagcatgtcgagaaactgctgtccctcaaggtcgacggactgctcatcgtgcagtgcgagaccaaccccaggcccacgcttggccatgactggggcgtgccactggtctacgtctacggcccctccaccgaccccaaagactgctcggtcacttgcgacaacgtggacgccggccgcatggccatcaaccatctcatctcgtgtggccgccggcacatcgccattatcggcggcgacgaaacctataccgctgccaccgaccgcaccaagggagctctcgaggcgctctccgaattaggtattgaacccgccggcccaattcgttacggcaaatgggacgaaggctggggccgtgcggccacccgtctgctgctcgaccaaggggtcaagttcgatgcagtggtctgccagaacgatcagttggcccgcggctgcattgacgtgctcaagcagcagggactgcgcatcccggatgacgtcgccgtcatcggccacgataactggtcggtactgacctccagctcgaggcccgcactgacgtcgatcgacaacgaaaccgaaaccatcggacggcgtgcggcacgatacttggtcgatgccatcgacggcaacccgcatcacggtgtcgactacgtaccctgccaccttatccagcgcgaatccaccctcccgctggactgatatcaatcgataccctaccgcttcttggttttgcgcccctttaagtagatgtcgatgacgatccatacgccgagggcgaaggccacgacgtagcccatgaagccgatgaccggaatgccgaagataatcggcttcatgccggcgtagtagacaatcgacgagccaacgaacaaaccgaccacaatcagggccatcgtcagacgattcaccatatccgaaagcagctggaacggctcttcggagccgaccagttccatgttgacgcgcaactgaccacgggtcagcatacgggccacggtcttgagttcggtcatggtgccgagcgtggcatgcaaagcctgatgtccctcaacgcccagcgacttgatctcgtctttggtggcgttcttcagcgatttcgacgtggcgatatggtcggaaatgatttcgatcatattcacatcaggaatgaactcgtccagcaagccttcgagcgtaaccaacgcgcggccgacggtggtcaccgtactgggcacctcgatgttgtggcggccggccatctgcgtcagtgcggtcaggaaggcggcaatgtccagttcggccagatccacggtgccgaattccttgacgatcacgtccagatcagccagcagtgctgggtagtcctccggatcggcctcggtgccggcaaatcgcagcagcccctcggccagagcgggcgaatcctgtttggcgacggcgaaaatcatttctttgaggactgcacgggtgcgctggtcgagccgaccggtcataccgaggtcgataagtacgatctggccgccccggatgatgatattgccgggatgtgggtcagcgtggaagaagccgtcgtcgagaatctgcgtggcgtaattgtcgacgagcttggtgccgatctccttcaagtcataaccagcatcgacgagccggcccggatgggagacggagatgccgtcgatgtactccatgaccaccacatgctcggtgcacagttcggtgtacgccgtcgggcagtccatgtatttgaatcgggcggcgaaacgcttgaattcggcgagattgcgggcctcgatcagaaagtcagtctccgattcgaaggtgtcccacagctcctcgaccacgcccttcaggtccacgatctgtgaggtgcgaatcaccttagtggcggccttggctatggagcgcatgatggagacgtcctgggccatggtttcgcgcacacccgggcgctgcactttaatagccacatcttcgccggttttcagcgtggcgcgatgcacttgcgccagtgaagcagagcccaacggcttggggtcgatatgcgcgaacacctcgtcggcgggacgcccgtattcggcggcaagcacatccaacaccgtggaatacggcatcgggtcggcgtcggcgcgcagtttggcgagttcgtcgcagaagctttgcggcagaatctcggagcgcatcgacagaatctggcccactttgacgaacgtggggccgagcgcctcgaacatgaggcgcattttgaccggagtcaggccgtgcagcacgtcgaattgctcgacgattctggtgatctgccccagtcgtttgatcttgccacgacgcgtcagatggtagcgcgtggcgaaatcgttcctgcgtccgaacagtgccagcgtttcgtcggatacgctcggagtcgccttggtaacggtctgcttgagcgtgtccgacgtgtcgacggaccggttcgccgccgcctcacgttcggctttcgcaggcgtcagaatagggtcgaccctgctggaaagcggggtcgaccctgattccggcgtagcgcgtgtgggcttggtcactcggccttgccctcgtcagcgggcttgtcggcggcactggtgtcggctgcggcagcagctttgtcgccggcttcggcggcggccttcttggcgtcatccaccgtctcgctcaccttgcgcttgagctcggtgttcagcgccttgccctgctcgaccgtaatctcacccttcttgacgagttcgtcgacgagctcgctgctcttctcgtatccggtggcaagggctccgatgcccgccagcaggaccttgcgcaggccatcacccagaagatcaaaatcagccatgatacccctccttcgaggtccgacatggcctggtgccatgtctcgtaccaccaagcctagcgcaaacaacagggcaatgtactagaccctcagactgatttcgactgatttttcgctgattggtacttaccgaggactcaccgagaattcaccgaggacgttcggcggcagccttgcgcgcgttggtggctacttgatcgagccgggcgagctccttggcttgttcgggggtctgatcggacgtatcgaacgtaccgtaacgacgagtcacggcagtttcgataaggaaatcgctgatggcggggtttttaggcagcaacgagccgtgcatgtaggtgccgatcacgttgtgcacgcgcgcgccctcggtatggtcttcgccattgttgcctcggccatcctgatcgacggtgccgagtggctgaacgccttcgcgcaggaaggtctggccggagtggttctcgtagccaatcacatcgccgaactggtcggaatgctcaacaagattgccgatcatacgcacgttctggcccacggtataagcaccgataacgccgatgccgtccagacgggtgccgtccacggtttcaaagtactcgccgaacagctggtacaggccgcagatcatcagcatcggcgtaccgtctgcggcaagcgaacgcaacaggtcggcgcgatggtagaagtcgtcgatgattttcttctggccggtgtcttggccgccgcctcccagaataaggtccacctggtcgggccagtcgtcgccttgattgtactggtggacgaccggttcataaccgtacagttccagacggcggcggatagtcagcacgttgccggaatcgccgtagatgttcatgtctttgggatacagggacaccacatcaattgttctggccatgtcacgttctccttgtcgatgtcttcccgctgacgggaagcgtcttattcctcaccatgtcctcccgcaggcgggaggtggcgcgcgggcgctagaggatagttacttgcccacgcccgcgtcccgtacttcggtgatgcggcccagtacggcgcgggttttgagcatggcggtgtaggtgcagtagatgtgcttgcgtgtgccgggattggcgttgacgaatgcggtgacggcctgttcgaggtcggtgttcgtatcggcgactggcacttggtcataccccaggcgcaatgccatgtcccaggcacgcacgccggagaccatggcgacaccggacgcgcgcagggaagtgaagtccacgtcccacagccagctcatgtcgcggccgtcggcatattcgtcgttgatggcgatcatggtgtccgcgttggccgggtcgaagctggcgagcgagaggcggaagcccatcgggttcttgaccagcagcagttcgaccggggaaccgttgacgtcgatgacctcgccacggccgaaagccggcgtgacgcgggaaacggcggcgatgagctcgtcggcggacacggcgcaggcgttggctgcggcggtggccttggatgcggcggcattgtcttgcatcaccgcacgtaccacggcgagcgcggcggccgcgttgtacaggttgtagacgccttcaagcttgacgtcggtggcgtagccctgaccgtccatctggaaggtggccttgtggtcgcccactgcggtaagtgtcacgtcggcgggaagttctgccgtgcctgcggaagctcctctcagttcgcttcgcggactgaggggagttctggctgaggggagcggcccggccacaccttccaccgacacggtcgtggccatgtcgtcatcggacgggaaatagcggcgcaaatcgtcggcgaggccgaagtatcgcacggtggtgccagccggggccttcgcggcgagcgcggcgatacgcgggtcctcgcggttcagtaccacagtgccggtagtcgccgcagccacatggctgagcagtttggccgtggtgtcgatttcaccgaatcggtcaagctgatcgcgcatcacgttcagcagcaatgcataacggggcttgacctgcttgacgaagtggacggcgtacgcctcatcgagctcgagcacggcgatgtccgcgtccaatttgccgccgagcgtgacttcggtaagcagtgcggagaccacgccgcgcacgaagttcgagccggtcggattggtgaacaccttcagccccagatcggagagcatcgaggcgaccatgcgggtggtggtggtcttgccgttcgtgccggacaccaataccacgccaagcggcaactgcccgagcgtacgggtcaggaagccggggtcaatcttttctacgactttgccgggcaaagccgaaccgccatgtttggtgacgcgggatgcaaaccgtacgaagcggcctgcggccacggtggcgaacgcataccacggtttgcaggtctgcaccacggacgattggtcttgcgaaacatcgcgtgaaacgttgcttgccatcatcacaccccctgattggcgttgtagtcctgcggcatgtctttgaatttggacgtggcaccgaggaaggcgaggtggaaggtttcggtcgggccgttacggtgcttggccatgatgatatcggcctcgccggggcggtcttccttgtcgtagaagtcagggcggtggaccaggaacaccacgtcggcgtcctgttcgattgagccggattcacgcaggtcggagagctgcggcttcttgtcgttacgcatttccgggccacggttcagctgggaaagggccacgaccggcacttcgagttccttggccaagagcttcagggcacgggagaattcggacacctcttgctggcgggattccacggccttgcccgaggtcatcagctgcaggtagtcgatgactacgagtttcagatcgttggtctgcttcagacgacggcatttcgcacggatctccatgaggctcatgttcgggctgtcgtcaatgaacagtggcgcgttctgcatcttggtccagaactggttcagggtgttccagcgttcgggggtgatgtcgtcggcgcggcgcagggcggccatcggaatattggtttcggcggagataatacgctgagcgagctccaccttgctcatctccaagctgaagaccacggaagtcatgttgtggtgcaacgcggcggcgcgggcgaagtcgatgccgagcgtggacttacccatggccggacgtcctgcgacgacgaccatctgtccgggctgcaggccctgggtcacgtcgtcgatgtcgcggaagccggtcggcacgcccttgttgacgaggccttgctgcagtttgtccagctggtcgagcgcgtcgtggaccaccgggccgatggcggcatagtcctgacgcaccttgcccatcgacatctcgtagatctcggactgggcgaggttaaccacatcctcagcctgcgatccctcggcggaataaccgagctgggcgattttggtgccggcggcgatcacattgcgcaaaatggcccgctgatggacgatctccgcgtagtacatggcattagcggcggtcggtacggatgcgacaaggctgtgcagatagtccgcgccgccgaccttgtcgaggttgccatccgccaacagctggttggccacgagcaccacgtccaccggctgactggcggaaaacagatcgatgatcgcgttatagatcgtctgatgcttgggctggtagaaatcggtgacgtcaatggtctgcgagacctcgccgatggcatccttactcatcagcatgccgccgagcacggccatttccgcgtcgtcatcatgcgggggcacgcggtcgaaaatcgggtcgccggccgccgccgacgtctgcgtgccgccccggcccgcgcggtcgccacgatcgccacgatccaggccaccgccgaacccattctgatacgagtgttcacttccttctggcatagcctccaagtataggatgtggcgtggcaggtgaacgatatcgtatggaaacgaaacggttgcccgcatcggttcattccttattcacctatgagtcagcgccacgacacgcagaaagcaaaatgtggatagaaaaataagttatccacattttggggataattctggggataatccactaagttatccacatactggggataacttggtggatagtctggggataacattccgcgcccacaacaggtgcttgcgcaacgcagtcaggcgtgatatgcgtgtgagcgtgcccatagactcttccgacgccaaagccaccagttccggcgatactacacgccgcgatggcttcggcaccccgcatgccggcgcaaacacaaacgtcagcaacggcccgaccgacgcccgctccaccaaccgccggatcatggcgctggccctgccgaccttcggccagctcatcgccgaaccgaccttcatccttatcgacacagccatcgtcggccatatcggggatgcggcgttggccggcctgtcaatcggctccaccatcatcctcacggcagtcggactatgcatattcctggcctactcgaccactgcgcaggtggcacatctgctgggagcgggtcgtcgtcgcgagggactgcaggcaggcattgatggcctgtggctggccttgagcatcggcaccgtactgggattgggattgttcgcggctgccgagccattatgccgggcactgggcggtcagggcgaagtattggaacaagccgtgacctatacgcgcgcaatcgtgctgggtgcgccaggcatgctgatggtatatgcggcgaacggcattttccgaggattgcagaaggttcgtatcacgctgatcgctgcggtgggcggcgcggtggtgaacacggtgcttgatgtgttgttcgttattgtgctgaattggggcattgccggctccggagtggcgacgctggtagctcagtggttcatggggctgttcctggtaatccccgccattctgtggtcccgggcggatggtgcgagtctgcggcctcgtttggccggtattgcggcagccgggggcgacggactgccattgttcattcgcacattggcgattcgtgcggccatggtgactacggtcgcctgtgccgcgcgcatgggtactgccgtgttggccgggtttcaggccgtgaactcctcttggaattttgcgatgaacatgctggattccgtgggcatcgccggccagacgctggtggccacagcgctgggcgctggcagcgtgcagcaggcgcggcggctgacgcgggcgaccgggcgtgcgggactggtcaccggcgcggtaatcggcacggcttttgcggtagtcggcctgttcgccgggcacttcttctcccctacgccacatattcagacgctgatcgccgtgggcatggtgacgatgggcatcttcttcccactgcaaggctggatgatggcaatcgacggcattcttatcggcgcgcgcgactaccgctatctggccgtcacatgcacgctgaccgccgtggtgtatgtgacgctcatactcatactggccaatatggtgacgccggcgctgacgagcgacctgatgcgtaccgccgtactctgggccgcgttcaacgtggtgctcatgggtgggcgcggtctgtccaacggactacgcgtgcgctcggacgcatggatgaggtaggtatcggccgcgcgaagcgctgggcgattccgtttacatagcggcgcgggcggcggaatacatgccgcggacgatttgttcgcgccacttggaccagccgtattgcttggtgatggtctcaccggcggtggcaccgagcgaggagccgtcggcccgggtcaggtcgaacagcatatccagcagcatcttgtcgtggtgcaagcggtcggccaactcctccgccacggccggatcataggggtccttacccgtggcaaattcggatagcgtcaaatgctcacgcaccagcacggtagcccagtcgacgatgtccggcgcgtagcccatacgcttgagaatcaccggcacatggcgggcaccctcggcggcgtgatcggccacgaacgcgcgcttgccgatgtcgtgggtgataccggccaacagcaatgccttgaaatgatcgtcatcgtaccgtccaccggacggtgtctcacgacccagacgcgacgtgacctccaccatatgccgatcgatggtgtaccggtgggcggccgaggcggacggacggttgcggacgccgagccattccggcatccatcgacccggaatgtccacgaaatcgatgctctcccacacttccataagattcgatccgcacgcaagcagacggataaacagctcgcgcgattcgtcatcccactggttgtcgtgaatcgggcagcgcttcagattaaccaaggtagacgggttgatgggaagaccgaattcgccggccgccacggccatacgcaacgccagcttggcatccttggcaggctcggcaccgggcgccaacaccaattcgccttcgtgcttggccacgccgggagccaccacgtcgaattgcggggcttcgcgcttgccaccagagcgctgagagaacatctggaagaacgcgaatcgcggcttttcgtgggtcagcgaatgttcggcgcgggaagcggtggaatcaagcgagaaggagatgcgccgaccgatacgggcaagcagtgtctgcagatcgtcgatcgagtaggcggcacgctcgttttcgggccaagtcggatcggcaaggccaagcatggcagccactttggcctgatagggcgtcagcatcaggttggtatccttgccggccaccagatggatgcagtcgcgtacgtcgagcagacgttccacagcttcgtcgtagatgccgtgcgggcggtcggccagccatgaggcggcgagcgcggagacgagcaccgaatcgcgcaaccccccacgggcctctttgatgtcgggctgattgacgtattggagccggccgaattcgtcgagtcgggctttggcggagtcgagcagttcgggcaggcgcttgcgggcggccttgcgccagcgttcgaggatggacgtggcggtggtggtgatcagagcggtgtcgccggcgatgggcttcacgtccagccagcccatggcggcgggaaggtcatggtcggtgacttcctcgcattgggcgcgcgtgcggatggagtggtcgaggtccagaccgctgtcccatagcgggtaccagagtttgttggccaactcgttgagctgctggtcgttcaacgtgcgaggctcgtagatgatgaccaggtcgaggtcggagctgggacccagttggccacgtgccagcgagcctaccgcggcgaagccgatgccggagtcgggcacggggaaagagacatccttgcaggccgcattccacagctcagtgaggcattgcatggccagttctgtgcgggctttgcgcttggtcgcaccattccggtagacgccgtcgtcatccggctggctcatatccatgaatcgttgtttcaagccatctactgctgaagtcattgcttcatctttcattgccaaaaaaagtccccgcacggcgtcaattcgcggcgtgcggggacctttcctatgcagtccatccccttctaagcatggacgtctgtgttatcagatcgcggcggaaccggtctcaccggtacgcacgcgggccacggagtccagcggagcgacccacaccttgccgtcaccgatggtgccggtgccggcggacttgatgatcacaccgaccagcgtttcggcatccgcgtcatcggacagcacttcaacgcgaatcttcggaatcaggtccacagtgtattcagcgccacggtagacctcggtgtggccgcgctggcggccgtagccgttggcctcggacacggtcagaccgtgcacgccggcggccgcgagggcctccttgacatcgtcgagcttatggggctgaatgatagcggtgatcagcttcatttcacttcacctccttgagaacggagctggcagtaccagcaaaatcgtaagcacgttcgccctggtcggcaagatcgatgccgccgacttcctgggcttcggtgacgcgccaaccgatggtcttctccagagcgaaggcgatgatcgcggtgatcactgcggagtagaggatggcgacgagagcgatgaccagctgaacgacgagctgcttccagtcgccaccagccagcagaccggtgccttcaccgaagaagccgatgaggatggtgccggtgaaaccaccaacgccatgcacgccgacgacgtcgagggagtcatcgtagccgaacttgaacttgagaccgcaggccaggcaggtcaggacaccagcgatggcacccatcacgatggcccacagcggggaaaccacatcggcggccggggtgatggcgaccaggccggcgaccatacccgaggcggcacccatggcggtgtagtgaccggagcgaatcttctcggtgaagccccaagagagcattgcggctgcggtggcggcggaggtggaaacccaagcgtaaccagcagtaccgttggcggcgaaggcggaaccagcgttgaagccgaaccagccgaaccacagcaggaaggcgccgagcatcacgaacggcacgttgtgcgggcggaacggctgcgtgccgaagcccttacgcttgccgatgatgagcacgatgatcagggcggcgactgcggcgttgatgtggacgacagtaccacctgcgaaatcgtgggcggccgcgccgatggccttggagatggcgccgtcagcagacagcagaccaccgttccagaccatgtgggccataggagcgtagtcgaaggtgacccacagcgccacgaaaatcatccaggtgctgtacttcacacgctcggcaatggcgccgcagatcaggccgacggtaatcatcgcgaaagcgacctggaaggcgacgtccacggaaaccgggtagttgttgccgttcagaccggtggcggtgaacacgccgtcctgggcgaccatggagtccttcagcaggaagccgctggccgggtcgccgaagatgcctccgatgtcggaaccggcgtaagcaatcgaccaaccccacagggtccagataatcatggtgaccgacagggcggccgcctcaagcatcagcatgttcaggacggccttggcacgaaccataccgccgtagaagaacgccacaccaggcgtcatgaggaaaaccaaggacgcggatgtcaggatccatgcggtgttaccggaatcaatcgctcccatgtctacctccctctctttcgttcagggcaccgggggctttgcgcggccggcgtcgactttgtctctacaatgccgtcccccttgtgggggctaacagttcgtcagtaaaagccggtctcgttttggtttcgttacggcaagttacgcgattgttaagcgcacctgacaattaggttggcatcggatgggctgattccggcatgattccaacggatatgggaaagccccgaatcatgtttcgaatatgcttcggggctaggtttggtgcgttgcgggcgtttcccgcgcccacaacgtggacggacgcagggctcccctcgctgaggggagctgtcgagcaaagcgagactgagaagaactcgaccgtctacgcgagaatgccgtccacgaaaccttcgggatcgaaaggtgccaaatcgtccggaccttcaccaagaccgacgagcttgaccggcacgccgagctccttctgcacgctgaccacgatgccgcccttggcggaaccgtcaagcttggagagcaccacaccggtaatgccgatggcttcggcgaacaccttggcctgggccatgccgttttggccggtggtggcgtcgagcacaagcagcacttcatccaccggcaggttcttttcggtaacacggcgaatcttgccgagctcgtccatcaggttcgacttgttctgcagtcggccggcagtatcgatgatgagcacgtccgcgttcgcttccttggccttggcggatgcctcaaaggcgacggatgccgggtcggcaccgtccttgtcggagcggacgacgggcacattgacgcgtgcgccccaggtttcgagctggtcggcggcggccgcgcggaaggtgtcggccgcgcccatcatgacctgcttgttttcggccacgaacagtcgagccagtttgccggcagtggtggtcttgccggtgccgttgacgccgaccatgatgatgacgctgggcttggcggcacccggcttttcggcattgaggcggcggtccgtatctcgaccgaccagatcgagcagcttctccttgagcgtggcgcgtacttcggctgggtcggctttaccagtgatgcgggcgtcggttctcaggtcatcgaccagttgggcggaagcatccgcaccgacgtcggcaagcagcagtgtgtcttcgacgtcttcccaatcggcctcggagagattgtctttggcgaggatgtcgaacagggccttgccgaacgggttgccggacttggcaagttttgccttgagtcgggtcagtcgagagccgaccgattcgggggtttcaggtttggcgggagtgggcttggaggcaggttgggactcgggcttgggcgcagctgccggttcgggttcggcctgcgcggctggcgcaggctcggctttggccgattcggctgacttggccggctcggcggcagtcgcagccttagcttcctcggcttcggcggccagccgagcgtcggcggcggccttggcgtcgcgggtcttcttgttgtcgggggcaaccttgcccatcgcacgatccaaatcgcgcttgcgggacttgcccaaccagatgctcagggcgattacgataaccgccgccacaatcacgccaagaacggcgagcacagtattcatatccatacctgtcaagtctagcccgcagatggaatcccctacgaattcggcagtctcaggccgacaattccacccggcgacttaagctgaaccgcatggcacattcttcacgtatgacgtcgctgcagcgccgcgagcagctgattgaagtcggacgctcgctattcgccgccaaaggcttcgaagcggtaagcgtggaggaaatcgccgcgcacgccaaagtctccaagccgattgtgtatgagcatttcggcggcaaagagggcctgtatgccgtcattgtggatcgtgagatgcgcgcgctgaccggtacgctgaccgccgcgctcgacgatccgaccgtgcacccgcgccagattgtggaacgcacggcgcttgcgctcctcacctatatcgaagagaatgccgaggggttccaggtactggtacgcgactcgccgagcaccgacccgtccggctcattcagctcgctgatgggagacatcgccgtacgcgttgaagacattctttccgaaacattcaaacggcagaagctgtctgccaagggcgtgccgtactacgcgcagatgctggtgggcatgaccgtattcaccgggcagtactgggccgaccggccaaaggtgagcaaggagcagctggctgcatacattgtggatttggcctggcatggcctgagccggcttgactccaagccccagttgttctttgagggcgccaaggcgcggaaggaggccgagcgccgagccaagcgcgagtccgattccggcagcccggattcagaccagacgagttctgcccaatcggatcccgagcacgccaccggggaagattcagggttgcagaacatgcgttcaggggcacaggttacgcaacactctgccgagtcgggaggcgaagtgctacggtttgaacaggaaactgaacataacgactaaatatgtgaggacgtaagactttcatggccagcacggcaaagacgctcacctttgtgatccccgcatacaatatggagtcctaccttgaccgttgcgtgaactcgctgctttcggcaagcgacatcagcgacctcgaggtgctgattgtggacgacggttcgaaagacggcacgctggagtacgcgcgcaagctggaacgcaccaatccgggcgccgtgcgcgcgattcatcaggagaacaagggccacggcggcgcggtgaacaccggtatcgcggcggcgaccggcatgtacgtcaaagtggtggatgcggatgattgggtcgacccgcaggccatcgacacggttctggccacgttgcgtgcacagcatgacaccgacgaaccgattgacatgctggtgaccaattacgtgtatgacaaggtggccaagcgtcacaagaccgtagtgaacttccgccgtgtaatggaggccggccgcgtgctcggctgggatgacctgggcaagttcggtctggcgcagtacatcatcatgcatgcgctcaccttccgcacgcaggtggtgcgcgattccgggctgaagctgccggagcacacgttctacgtcgatttctattactcgtaccagccgttcccgtgggtgaagcgcatccagtacctcgatgtgccgttctaccactacttcatcgggcgcgagggtcagagcgtgcagaccgacgtgatgattaagcgtgtggaccagttgcggctcgtcaatcggctgatgaccgaggccacgcccgaacgcggtacggtgccggaggggctgtaccggtacatgattcacttcctggcgatcgaatcgtgcgttacctcgacgttcctgattctctcgcgcgatccggccaactacgttaagaaaaccgagctgtgggatgcgattgacgcctattcgccggccatcggcaaggatgtgcgctcgcagctgatgtcccgcgcgctcaatctgcccggcaaaaccggccgctggatcgtgcgcaacggctatctcatcgccgaacgcatcgtcggctttaactgattcggattgtggttttgccctgctgacgcgttatcagcagggcatccctattacctccccagtcgaggttttgctactcggcccaacggtcggacatcgcgaagctgttgtgcatcaggttgctggaggtgtatagcacgtcgttcagcagcttggttgtgtgctcgcgcaggtagtcggccatctcgtcgttggccgcttcgagcacatccgccacgccctgcacatccttctcatcgccgtggccgccatcgagcggccatgcattcgtatccgtcgattcggcatcgcttcgagcaagcaactgctcatccgtgcgctcgatgagccggtgtccgaacgcgcgcacgccctcggcatacccttcgatgaaccggttcgtctcataccagtgtgcgtcggccacgacggcgatcaggcggttcgtccaatacaggttgccggtggagacttcgggcgtggtgtcgcgcaggtaggcaggcgtgtcgttgacgttcgcgtagaacggcgcggcggcggtgaacggaccagagccgaacgatacccacatcaccgtgcgattggccgccggcacatacggacggacctgaatcgccaccatatggccggtgcggttcacgccgatcggacggtaacggtggcgcgattccgccgtgccggtcgtgccgtacgggtcgtacggcgtgccttcgaagtgcgaggacagcaggaaatcaacgtcttcgaggctcaccttgtcttccggcacgcggcaccacgggatgtcgtcggattcgggcgtgtagcgggcggccggcgaatcccagtcctcgctggggttgaggcggcgttgcatgtaccaggcacgcggcgtgttgtagatatggtccttcggcgtcgcggtgccgaaggccttgcgcgggttgaaacgggtgggaagggcaacggttgttccgaatccggcgctatgcgcgtgacggccgttggaagagaccggcgttcccattgtgcggtcgaggtgatgcgtggccatgaactcgcgcaggtcggcgctgcataggtattcgcgctgctcgccgaacgcatcggcgaggtcgaagtcgtcgatgccgagctggttggggatcgtggcatagcagtcatcgggcactcggcgggcgatccaatggtggccgccgatggtctcgacgtaccagatctcgtccacatccgaaataatcacgccgttcgattcgtaggtgccgtaggtttcgagcagttcgcccaaccgcgcgacgccctcgcgcgcggtggtgacatacggcagcacaagggtgatgatgtcttcctcaccgataccgccgggctgctcggcctgataatcggtgctgtccggttcgccgacagccggccgcaactcgaccatcgggtccgcaccgagcacgcgctcgttgacagcgatggtttcggtggcgctcatcgccacgttgtgttcgttggcaccggcttcggccagaatgccacgattattcagcacgttcggtgcgatggtgtaccggcaaggattgtccggtagttcgatttcgacatggctcagcacgctgcggtagtggcgcggctggtcgtcgggggcgacagcgacgaagcgcttgggatcgtaacggcccgagcccgaatcgtcatcgcgggcgatgatggtggaaccgtcgtaactggcatttttgccgacaagaatcgtggtgcatgacatgggacaccactctaggagccaggctggtcgaaacaaaaaaatccttggaaccattgcgattccgaggatttgttgtgccccctgtgggattcgaacccacaacccacgacttaaaaggacgctgctctaaccgttgagctaaaggggcaactcttctaaaatacacaccgttttgggatatttcaactacggcgttgcgtacacgtttgcgtacgcgattggcccaacgcacggcacagcacacgcaatgtggcccaaatcgcagcccaaatcgcatatcgcctctagcgatagatagccgccggcgactacccttgtacattatgagtgaatcccccaattggagcaatcccctgcgcgactcgcgcgacctcagactgccccgtatcgccggcccatgcagcctcgtcattttcggtgtcacgggcgatctggcacaaaagaaactactgccagccgtctacgacctggcgaaccgtggcctactgccgccgagcttcggtctgaccggtttcgcccgccgcgactggacacaggaacggttcatcgaattcgtcaaggccgccgtccaggcgcattgccgtacgccgttcaaggagtcgacttggcgcaatctggccgccggcatccgcttcgtgcagggtacgttcgacgacccggaggccttcgagcgtctgagcgccaccgtgcaggagcttgaccgcgaccgcggcacgcagggtaaccatgccttctacatgtcggtgccgccgcgcgcattcccacaggtcgccaagcagctggccgcctccggcctgtcgcgctcgtccgagggcgcatggcgccgcgtgatcatcgagaagccgttcggccatgatctggccagcgccaaggaactcgacagcgtggtatccgaagtgttcgacccgagctccgtgttccgcatcgaccactacctcggcaaggaaaccgtgcagaacctgctggccctgcgtttcgccaacgccatgtacgagccgatctggaacgccaactatgtggaccacgtgcagatcacgatggccgaggacatcggcatcggcggccgcgccggctattacgacggcatcggcgccgcacgcgacgtcatccagaaccacctgcttcagctcatggctctgaccgccatggaggagccggtgagcttcaccgccaaggacctgaccgccgaaaagaccaaggtgctttccgccgtgcgcctgcccaaggacctcgccgccaacaccgcgcgcggccagtacgccaagggctggcagggctcgcacgaagtggtcggctacttggaggaaaaaggcatcgaccccaagagcaccactgaaacgtacgccgccatccgcctcgatatcgacacccgccgctgggctggcgtgccgttctacctgcgttgcggcaagcgcctcggcaagcgtgtaaccgaaatcgccgtggtgttcaagcgcgccccgcatctgccgttcgagcagaccgccgtgcgcgaactcggcaagaacgccatcgtgattcgcgtgcagcccgacgagggcgtcaccatgcgcttcggagccaaggtgccgggcggctccaccatggaggtccgtgacgtgaacatggacttcagctacggccgctccttcaccgagaactcgccggaagcctatgagcgactgattctggacgtgctgctcggtgatccgccgttgttcccgaccaccgaagaggtgaacctcagctgggagatcctcgatccgattgaacaattctggtccacgcttggccagccgcaggcctaccgcgccggtacgtggggtccggcacaggccgacgaaatgctggcgcgcgacggccgccactggaggatgccatgatcatcgatatgccgaacacccgcacccgcgagattgcgcacaaaatcgaacagctgcacgaggagcgcggcgaatcggcgaccggccgcgtgctgacgctgctcatcgccaccgaggacgcggacctagagcatgcgctggaaatcgcgaactcggccagccgtgagcacccgtgccgcgtgattgccgtagtaccggataccaatcctgccgatcagtccggcgaaggcgaaccgaacgcggccgaagtggccgccgaggtgagcgcgagtcgcgataatccggccgtcgatttgaccgacggcccgaacgatccgaacgattccaacctgaacgcccaagtgcgattcggcgcggacgccggtgccggtgagatcatcatcttgcgtccgcgcggtggccttatcaaccacccggatacgctggttatcccgctgcttgtgccggatgcgcctgtagtggcgtggtggccgaccacaccgccgtcgaacccggccaaggatctgatgggtgcgatggcccgcagtcgcatcaccgacgcgttgcactccaataatccggaggccacgattgagcgtttgcgccgcaattggacaccggaagatatcgacttgtcctggacacgactgaccgtctggcgcgcaatgctcgcctcgatgctcgatcagccgccgcacctgcccatcaccgccgcgaaggtgaccggcaaggccgacttcctgcctatggaaatgctgtgcgcatggctgcgtctgaaacttggcgtaccagtcgaaactgagttcgtgcccgacgcgcaggccgtgaccggcgtgtacctgacccgtgaggacggtgtgatctcgctggaacgcccgtatgaggaccaagcgctgatctcgctgcccggccagactccgcaggaagtgtccgtgccgatgcgcaccatcgaggactgcctgaccgaggaactgcgtcgcatcgatcccgatgagatctacgccgaggtcatcaacgaaggctgggatctgattcgtcactgaagtcggtagaacccgttgccacagcggcgttggcatgagttcggcaattgtggccgagccatgccaacgccgttgctcatcgtttcctacctcatgcgatgccgaagctcatgcccgcggagtaataaagtgacatatgtgatgtcgcacaatgtacattgtgttgtcaactgacaacacatttcattgctgcaaatggctagattcccggcatgccacccgtatcatgcgttgtcaactgacaacacaatccacattgcaaagtacgacacataccccatacaaggaccatacatggcaactcgaaaactcattgtgtatccgaataaagatctgatgattcaggctggcgcgcaacgttttgtcttgacgctactcgatttgctcgccgaacgattgcctgatgacacgcatcgcacgcgtgtggatgtggcgctgtctggcggttcggccgcgcagccgttgggctcggtgctgagcgatccgctggctgacgcgattgattggtcgcgcgtgcatttctggtggagcgacgaacgttttgtgccggcttacgacaccgatcgcaatgctttggaagcccgtcgcctgctgcttgaccagctggtggcagatggcaagctgcctgaatcgaatattcatgagatggcggccgatacccgttcagccgatgacatcgccgatgtgatggatcaggccgacagcgatgatgcttccgttcgcgccgccgccgatgccgcgaatgatgcgttgctggacgatgtcgcgagcgactatgagcgcgagttggtgaatgaattggggccggaaccggtaatcgatctgatgattctcggcatgggaccggacggtcactatgcgtcgctgttccctggtcatgatgaggtcaaggttaccgataggctcaccgtgggtgtgaaccactcccccaagatgccgccgctgcgtgtttcattgaccgcgccgctcatcgcgcgttcacgccatacgtggttcttcgccgccggtgccggcaaagccgaatcgctggcccatgtcttcgagcagcccaacaacccggattacccgtcctcctacgccaacggagtggacgagttcatctggttctccaccgaagaaaccgtcaccgagttgtgagtgaattaagccccctctgatgagggggcttaattcgtctatggctacgcctcgatctcgggcttgctgttttctcagctcggctatcgccgagcctgaagaaggccggacagcctgaccatggaaggccgctcaaacctcaggtgttgcaaccaccactagaatctgccaaactggcttggttatggggtcgctctacactggcttctgctatgcattacttcacccctaaacgttgcgctacgtcgaataaaatcatgtatcacgataaggcgcaggttcagcgtgccgctgatcaaagcctaatcgagcgcggagttgagctatgggtgtaccgttgcgaattttgcggatgctggcatctcacgcatcgcgatccgcaatccagttaccggcatgtaccgctgaaccagcaactcaagccacacagtcgtaaaaagggctacaagccacgtagacgttagcgtcagaagctccacagacctcgccaacgccgtgtctgagacaggttacggtccaaacacgtcaggtcgtaggctgctaagcgttcagggcgctcggacacacttcgtccaacacttacatcaccttggtgttttcaaggttgcggataacccaatcgttgaagcgaattaccggcttgcgcaacataagtcccaacagcaatgaggggacaaggaacagtgccagtttgcccatggaaacccagtattccatgccgaatgagcctgccatggccgaatgcatcgcatccaccgcataggggaacagtagccatttagaaacgacctggaagaacgtcggcagtgtttcaatggggaatgtgccgccggaaccggctacctgcataaccagcagtactacggcaatggctttgccgatatcaccgaacgacagggtcagcgtatacacaatattcgagaacaccagtgcagacaaccacccgaccatcaagaactgaatcggatgctcacactgcacgccgagatagaacatatcgcccaggcacaccagcgtaccttgcagcaaagcaaggaaaccgaaaatcatgtatcggccgaaatattcgtggtgcaagcgtaaaccgaactgccgcgcattgccgggagcctcggcacgcggcttcttcagcacatccaacgcggcggccggtccggcaatccgcccggcaatcatggcctcgcgaagacccacttccgaaccgagcggcagatcattgcccaaccctaagatacgagccttctcatggtcggaaatcgatactttcaacatggcgaccagaatgatcgcaccgacccaaatagacaaaatcgtgtagaacggagccatcgcggaaccatagttggcaacgggatagagcgcgatgcggtcgaccgctacgggtgccgccagcatggaagcaatggcatcgggcttcgcagaggaaatcacagacaggtcgatggtgccgccattggtgatagaggcgagttgggaagacaagttgtcgagtttcttcgccgaacgggtcaaagcgctagctgcgtcagtcaaggccgactggatgtccgtcaggctgtctgaaacgccgccagaaagacctgacacgctgcttacggtcgatgcaagcccgtcgattacggaacttgcctgcgtggtcacttcgtccatggacgaggtcagattgttcagttgcggtttcagcgtgctcttgtacgtgtctgaagcctgagtaatcgattgtttggcggcagcgatttgtgatttcagatctcgacgcgctgtatcggcatcggcagtaccgtttgctatgtgcgtggccgcatcgcccaacgcggtggcggcttgctgcatgctctgctgcgcctttgtggcttggtctgcagccgcgttcagttgagcggcaacggtatctccgcccacgggcagtgaagccgcttgtttggcgagatctcgtaaagcggcggcatactttccaaagctgtcggcctgagcctccactttggattgcatatcggttagcttgtttgatatctgtgaggattgtgagcccacatcggcaaaagcggcatcgatttgcttggcaatggtgtcgtaggatgaaccggcctgctgcaatgccgtaccgacgccatcggtggctccggacaatgccttgtcgaggctggagacgccgttgcgggtctgtttcaacgcctttttggttgtggccgcagctgagcctgttgatcccagcagcttatcggtggaatcaatgatgctgttggcggccccgagcagattggcataggaatccatctgcgacgcagtgccggtcaaacgagacgacatggtggcaatatgactggaggcgttgttgacgtactgctccatttgcgggctttgcgcgtaatcggccacgttggaaaccaaatccagcgccacgctcgccaaggtcttcacaaatgtctggtcgatggtcgtggccacggtggtagcaccctggtcggtgatatgcggagcgatcggattgattttctcattgagatagtattcgagcttggcgtgcttgatcttcggtgaaaacagcgtcatcatatcggagctgaagctctttggaataatcagcgcggcatagtattcgcctgagttcacgccatcgatggccttagcacgatccacaaactgccagtcaaggtcatgattggccctgagcgtattggtcacggtttcgccgacgttgatggtgatcggcatcagatcggacttatagcccttatccacgtttgccacagcgaccttcaaggccttggtgttgccgtacgggtcccagctggcggcgatgttgtaccaggcgtacagtgccggcacaatcaccaatcccatagccacgattacggcgatcacattgcgggtggcttggcgcacgtcacgtacgaatattttccagataagcttcatcgtgcgcctccttgcccagactgcccagactgcccagactgcccagactgaccggactgtgcggtgtgcgcagtcggctcggcggcctgatcgccgaacagtgtgagtcgttcagtggtttcgccgatatccggattgctgcccatcgccgcttcgtgacgtccgtggccgtggaaacgccgccacacatatccgttgagcatcacattgcggaactcgtcggcactcatggcactgacgccaagctgcatggcgtaggtttcgcgtgcgtattcaaccacaatgagataggcgtcgataagaataatcgacagaatccaggaggtcagcatggcgattttctcttgggtgacgaacagcagtaccaggaatacgaacgggagtacggtcagcaatgtcagaccggcaacgatcatctttggataccgtgcgaagaaccggtgcgcgcgatgggcgatgatatcgcgcagttccttgctgtcggacaccgtgcggaatacggagttcaagctcacctgttcgttcaccatgctgttgtgctcggtgatcatcaggtcggtatctcccaaacgacggtcgaacagcgcgttcaggttcatcgcataccggcgtatgacaagtcccacgaagagtgccgccggcagataccagaacaggtgcagcatgtcgagccagtaatggttcgcgtacaggccggcaatcgggccgcgcatcgcgttgatgccgtaggtaaagggcagccacgggtgcagttcgcggaagaagttcggcatcatttcaatcggatacaggccggaggcgccgggtatctgcacaatgaccagaattacggcgatggctttgccgatatggcggaacgccacggccagtgcgtaaataatgttgatgtatacgaacgaacagaagatcccggccaagatgaacagcagcggatgctcgcattggatgccaagcaccagatcgccgatggtggcgatgacggcttgcaggaatccgatggtgaccagcagcagccagcggccaagatatgcttgcgtagcggtgatacggcgaatgccctcgcggtcgacctcaagcttgtagatggcgattagcacgaaaccgcctacccacagtgccagattcgtgtagaacggggtgactgcggacccgtaattgtcggtggcatacacgactttcgtggtcagggtgacgggattgcccatgaagtcgccgaatcccttgtcatccagatgcagcgtatcccggattttctggtaagcggcggaactatcgagcgtggcgatatcggtgcgtacggtggcgacatcgctggccacctggcgcagcgaatcctgcgtgctgctgatggtggtttttgtttggttcagggtatcgacaagctggtcgaacagtccgtcggcctgatccaaggtgccggataacgaagtcaacgtgccatccagtgtgccattcagggcggcgaaactgttcaatgatgaggtgagcgacggcattacggtgccggtcagcgagccgcgcgcggtattcagcgccgcgatgccgccggtggtggtgttggtcatggctccggaaagattcgtggtggcgtctttaccggagttgatgaactgtgtggtgtcggtatggaaggtgttgagctgtgtctgctgtttgctgatcaatgagtcgagcgcatcgatttgtttccagatgttctggccgactgggtcggtggtgtctttgccgatgccggctttggtcagcgcgtctttcagatcgctgattgacgtttgggtggcattcagtggggccgaaagtgtgttggtgatggtgtcgacggagttctgcgcgctgttgaaggagccggtgatgctgccggcggcgttgttgacgtgaacggccagtccggagagttgtgctgaactggtgtcgagcgcgccgaccagtgtggtggagaaggcttgtgacccggcctgtgtttccgtcaacagtgtgccggactggcgggaggccttctgcgcggccgcgacggtctgcttgagtgaggcggtggtctgtttggcgtcggcgagaatcgtgtctgattgggccagcgtgtcctgtaagtcggtgagtgaatcctgaacggtgttcagcgtggacatcaccgtattgagatcattgatcgtatcgtgctggactttgccggtggcttggtcgagatcgcctcccgcttcggaaacggccgaggcaacggtggtggctaccgtggtgacgaaggcggagttgatctgctcgtcgatggtggtggcaccggtgtcggtgattttcggcgcgatcgcgttcttcttctcgttgacgtaatacttgatttttggctgtttggaggttccggtcaccgattcgaccaggctggtgctgaaatccttgggcagcacgatggctgcatagtatccgccggtctccacgccgtggacggcctgttcctcattgtctacgaagcgccagccgagttcgtcgttctgcttgagtttcttgacgacctgccggcccgcatcgagatggccgaccagatcgttggtggtgccttggtcttcattggctacggccacttgcagattgccggtggctgaatagggatcccagttggcgagaatgttgaaccatgcgtacagcgagggcagcattgctacgccgagcgtcaccacaacggcaacgggattgcgtaagatacgtctgcaatcgcgtagaaagacttgccaaaccgtccgcatccagtccctcttttccggttcgtaatcattgcggccacatgcagtctattcccaccactggtgcgaatactgctggtttggcgggttttcttgcaaaactggccgttggttgtccgcataatgggactgatatgtgaacgtttgttgatggtgcgacaccggcgggatggttgtgcaattttgccggtatccggtgatgaaatgttgaggtgttggaactgagtcgtcgcagtgctgagaccgagacgactcagtgacgagcctatccgaggctatctcgttggttctggtctcactgatccagacggaagccctgagcggcggccttgtcgagcagtgtctgatggctgacatcctgccgactgatcgtggcgacctgatcgctgaaagcgtccaccggacggtcggcttggcgcagatcgtagtaccggtgaacttcctcgtcgaaggcgggcagctggtcgagtacgccatcggcgtcagccgggtaggtgttctcgaagaactgcatcgtgcgcggcatgcgcggcttgacggtcgggttctgatcgggcttgccgatggccagacccagcaccggatacgtgtattccggcagattcagcacgtcgataaggccggggatgttgttgagcagagagccgagaatcacgcagcccagtcccagcgaataggcggcggtctccatggcgtgcagggccagcactgcgtcgttctgagcttgggtgaagcgatagctgtacttcagatggaattcgtcggaagcgggatcgatgcccttgcgttcggcgatgcgcgcgttgcggtgctcgtcgataacgaacacgtacagcaacggcgcagtggcgatatacggctgatggccgaattcggcgagcttggctttgatggccgggtcgatgatacggatggcggaccagtcgttaaggaactggctggacgcggcatgctgggcgacggtttcgagcgtggcgcgggtatcgtcgtcgatggcctcgtccttgaacttacggatggagcggcggcccagaagagcctcgattgttgcgttggtaaccatggttttattgtcgcacggcagacgccggacgccacggtggattacctcacagtgaaatgccgatattgtgtggcggaactgtgctggactgatggttcctgtcgattgactgatggttccttgacgaaaatccagcgatgagccatcagtcaaccaacagaaaccatcatccaaccgggggattagcggctggacttgcgatggcggtggtcgacgaacgccttggagccccgatccgacagctgcgaaaccactgcgccgagtgcggccgaaacggcggcgaatgccagactcattgccagaccttgcggcgcgtctgccgccagtcccttgcgcagattgcgtttgctcgtgcccttgtcccatatcatctggaatgctttgccggcaaccaagcctgccagcgctgggactgccgacttgatgagcttgtcgcccagagaatcagggtcgttgagccggtcctcgcgcagcctgttgaccttctcgtcgatgcggtgcaggctgtcgaccgcacggtcggcgctggaggggaagtcggtgttcgtttcgtcgctcatgactctcagtctaatagcatctcaatcatctcagcgcaaaagatgggcgttaatggtggagtcatgaacgagcgcagactagagtggaggcatgagcgaacagaacgtgaacggcaccgttgccgtcgagaactctcgtggcggcaacggatttttggtgttgctgcgccacggccagaccgtgtggagcgaatccgggcagcataccgggcgcacgaacatcccgttgaccgcggtcggcgagcagcaggcagcggatgccggaaggcgcctgcgcgaagctttccccgaaggattcagccagggctgtgtgttttccagtccgctgaagcgggcgtgccaaaccgctgaactggccggttttgcggaccacggtgtgttggacggcatcgctgaatgggattacggccgagccgaggggcgtacgcgccagcaggtgagtgaggccagcggttttgaatgggatgtgtggcgtgacgggccgcgctcgctgacgcccacgctggagggcgattgggtcgagaccttaccttcgggcgagcaggtgccggtccatgccgggcctggcgagacgctggaagaagcagcggtacgcgccaagagcgccatcgatgagattacgccgctgctgaaagacggccataatgtgctgttggtggctcatgcgcacatcctgcgcatcctcacctcgcaatggctgggcgtggacccgcatttcgcgcggttgctgcgtttggatacggcgcactactcggtgcttagcgtctataagggagataacgtcatcgaacggtggaacgcctagccccggttgcgctgtgattacgctggcctgcccgctgctgcgggcgggcctttattgtttgtggtgggaattgcggtatgtcgataaatgatttgcaaacgatagcgtcgccgtgttgttttttttgatgggtataagtggcaatcgattgccatgaaagatatgttagcgctctcataattgcgaacgcttgcattgcgataatgaggcaaaaatgaccgaattaatgggatatttgttgacgatggcctgaaaatgatgatttatgacgcgccgatattgctatcgtttgcaaaaagaagcaaaccgttgcacaatagtgcatgtcgatagtcataaaggtgcgtgttagcgtacctgtcctgaccggggacggccggggtcgacgatgaaagagaaaggttcgatgatgaatcgtacagtcaagtcagcagtcgcgatggcggctatcgctgcgatgtccctcggcactttggcggcctgcggaagctcgacctccggcgatgacgccaagggcaaggtctactacctgaacttcaagccggaagcggctgatcagtgggccgctctggccaaggagtacaccaaggagaagggcgttgatgtcaaggtccagaccgcggcctccggcacctacgagcagaccctgaagtccgaaagcgccaaaaccgaagccccgaccttgttccaggtgaacggcccggtcggctaccagaactggaagaagtacaccgccgacatgtccaacacggatgtgtataaggaactcaccaaccaggacgtggccctgaaagacggcgacaaggtggtcggtgtgccgtacgtgatggaaacctacggcctgatctacaacaaggacatcctcaacaagtacttcgcgctggatggtgccaaagccacgtccatggacgaaatcgacaacttcgacaccctgaaggccgtggctgacgacatgcagtcccgcaaggacgagcttggcatcaagggcgcgttcacctccgccggcttcgactccagctccgactggcgattcaagacccatctggccaacctgccgctctactatgagttcaaggacgacaacgtcaccgagcagccggccaccatcaagggcacttatctgccgaactacaagaagatcttcgacctgtacatcgccgactccaccaccgaccccacccagctgagcgccaagaccggagatgatgcgaactccgagttcgcgctcggcgaggccgccttctaccagaacggtacctgggcctggaccgacctgcagaaggccggcatgaaggccgaatccgtgggcatgatgccaatctacaccggtgtcaagggtgaagagaagcagggcttggccactggttccgagaactactggtgcatcaacgacaaggcctccgacgccgacaagaaggccaccgaggacttcctctcctgggtgatcacctccgacaccggcaagaaggccatctctcaggacatgggcttcaccaccccgttcaagaccttcgatgatgtcaagtttgacaacccgctgactgaagccgctgttgaggatcagaagtccggcaagacccaggtttcttggaacttcaccatgatgccgtccgaagagtggaagaacaaggtcggccaggcactgctcgagtacgcgcagggcaccggcaagtgggatgccgtcaagaccgccttcgtggacggttgggcttccgaatacgaggcttcgcactgagtctcatagagtcccatagccgataagtaacaatccgcggcgcccctgccatttccttctccgggggggcgccgctttgtattgctgagtctcgcacaaaatcgtccgccgcaaaaaagtgtgaggcacgcacccgctcaatcgcacactgtggggccatgaatcggcgatttttcgccattctccacaatgtgcgattgagcgttactgtgcggttgcctcacactttttctatggtgggctttgttgtgtgagcctacttaacgcgggaggtggaggagcggaccttcagctgggccgggaacacgatgtagggttgctcaatcggcttttcgtcaatgagatcgagcgtcatgcgggctgccacgcgggccatttccaccggatcctggcggatggtggtcaggccgatatcgccggtgtagaaactatcgtcgtagccgatcaacgagacgtcgccgggcacggagaatccattgcgctccagctggaacataagcggcaaagcaatgccatcctcctggcatgcgatggcggtgggcatctcgtcttggcttatgagttggttgaccacgtcgctgatttcataacgtccatcgtcatcgaccttgcagacgataacctgcggctcgatgccttccctgcggcagcaggcggtgaatgagtcgaatcggctttgcacggagaagctcagcgacacctcgcgattggtgctgatgtaggtgatgcggcgatgtccgagattgataagatggcgggcggccagcgtggagccctgcacatcgtcgatattgacggcggcggtaaagccgcgggctccgggttcgactgaattgatgccgacgatcggcacgccgaccgaagccagttgcgcgatttcgttgttgtcgatatcgaaagacgccacaatcacggcatcggcgttacggcgtaccggcaacatctcgaagaattccttgcgctcctcgatgctggaaatctggaataccgaaatatcgtagccctgcgtgtgcagcacctcgttgagcccctcgatgaccgaggcggtgaaccacaggcggatatggccgctcatcagtactgcgatgcgcagggagcggccggatttcagggccgcagccgagcgggagagtgagaaattgagtttgtcggcgatggcgagcacgcgctcgcgggtcttggccgacaccagatccggcctggtgaaggaacgtgagacggtggagatggagacgccggcctcgcgggcgacatcctgaatgctcgtagccattgcagcccccttgcgttgaatggaaaatcgcaatacacatgcacaactgactccagtgtacatgctgattgattgatctgcggcgatgacaacgattgtattacaaacgtttgcaaagtgtctatgtcggcgttagattggctttatatagccattatcttaggtgaaagaagattgctggagccggagtgtgctcgaacttgaaacgcctaaaatgacaacgtttgacatataatgattcgacgtttactatgaacataggcttgaacgagaacaggccgtgcatgcggttctcgatcggcaagctcgcattgagttgaactccgcagccggcgcacgatgcagtgtcgcaacgcagcggactcaaggaggaggaaaagtcatgatcagcatggctggcaaggcgatacgcaggtggtgggcgctgttcgcgcttcccacattcgccgcattcatcatcgggttcctagtgcccttcatcatgggcgtctacttaagcttctgcgaattcaccaccgttaccgacggtgaatgggtggggcttaagaactatggcaaagcgttgaaagacaaggaattcctgcacgcgctcggcttctccaccgcgttcaccatcgtgaccaccatcgtgatcaacgtgatcgccttcgccatcgcctacatgctgaccaaggcgatcaagggctccacgctgttccgctcggtattcttcatgccgaaccttatcggcggcatcatcctgggctacatctggctgctgctcctgaacggcgtactagcccactggggccgcgccctgacctataaggcgtcctacgggttctggggcttggtcatcctggtgtgctggcagcagatcggctacatgatgatcatctacatcgccggcctgcaagccctgcccaccgatgtgctggaggccgcggccgtggacggcgccaacggacggcagaccatgttccgcatcatcatcccgctgatgatgccgtccatcaccgtgtgctccttcctgaccgtgaccaacggtttcaagctctacgatcagaacctcgcattgaccaacggtgcgccgagcaacatgtctgaaggtctggcgctgaacatcacccgcaccttctacggccgtatgggctgggaaggcgtcggccaggcgaaggccgtgctgttcttcatcctggtcgcggtcatcgccctgattcagaacaagctcaccacgagcaaggaggtggcagcctgatgaacgagaacaagcctgtgaagcatggcgcattatggaccgtgctgtttgccgttgtctccctgttctggattttcccgatcgtcctggtgctgatcaactccttcaagcagaaggcgtacatctccaagaacgcgttctccctgcctgccggcaaagcgtttgtaggacttgagaactatgtgcgcggcatcgagaccacgcagttcttcgcttccttcggctggacgctgcttatcaccgtcggctcggtggcgctgattctggtgtgcacctcgatgtgcgcatggtggatcgtgcgcgtgaacaactgggccgcgaagctgctctacaccctgttcctgttcaatatgatcgtgccgttccagatggtgatgttcaccctctccaagatcgccgacatgctgaagctcaataccccgtggggcctgtgcatcgtgtacctcggtttcggtgccggtctggccgtgttcatcttcactggcgtgatcaagggcatcccgcaggagcttgaggagtccgccatgatcgacggcgcgtcagtgccgcgcatcttcttccagatcgtggtgccgattatgaagccgtcgatcgtctcggtggccatcctcgaagccatgtggatctggaacgactacctgctgccgtacctgacgctcgacctcggcaagtacaagaccgtctcggtcgccgtgcaatacctcaagggcggctacggttccgtggatatgggcgccatgatggcctgcctggtgctggccatcatccccatcatcgtcttctacttggtatgccagaagtatatagtctctggtgtcatggcgggagccgtcaagggctgacgactcgcgtcgtcagcccatggctggaagcccagtgggcttccagcaggctccaggctgagccgcgacagcggcgaagctaatgatgagcctcgtcgtaggcgagtccgtaattgcagggccgaaggcggcgcggtcaagggttgagcccgacaatttggctcccctccctgaggggagccaaaagctgtacaaggagtagttgatgaactggctggcaccggactcgaaattcatgcgcgcgtggagcaatcttgttgacggcgtatggatcaacattctgatgctggtcacttcgattccgatcatcaccatcggtgcggccctgactgccggccatgatgcttgccgccgctccatcgagggcgagggcaaaggcgtaacctccaactacttcaagtcattcaaaaccaacttcatcaaagccacactgctgtggctgccgttcttggtggcgctgattgcactggtctggtcatggatcgtcctgcagatcacgccgctgctcatcatcaaattcgcgctgaccatcctctggcttatcggtttcgaatgggtgttcgcgcttcaggcacgcttcgagaacaccgtggccggcaccttgaagaacgccttcatcttcggcatctcccacatcgcgatgaccgtggccctagtcctcgtggatgccgtgttcgtggcgctgctggtggccagctggttctacatgcccggtggactgttcctcctggtgatccttggttacggcaccatgctgatgctccatatccccgttaccgagcgtgttttcaatccatatctcattgactaggcgggttctctcgcgaatatgcggcgatcttcgaggtctgagcgctctctgtccacgcaagcgcggtaaagataacaaattgataacagtttggggcggctggcggagcggggtgccgattgagggggtattagtgattggcttggaagggggcttttgacatacggggggtgttcggactgggcggttgcccccgtaagtgcttatatacataaggaatctggcacactgagtctcagtgccgtaatggtatcatcgcaaataatgtttgcgttcacgtagaggcgaacgagacacccgacaagtgggtcgaggcaaaggacaaggagagatgcggtgaagcattggaagaagatggcagcatcgttgattgcaatatcaacgatggtggcagtagttccgacgacgtatgccatggaatcggaagattcccaaccacagacaaccgataccgcgacagtgcagactactaaggctgctgaaccgacgctgctcgccagctgggacttcacgggcaaaaacggcaccacgaacagcgcgattgccgattcgaccggcaagtacaacctgacgctgaaggacggcgccaagatcgaacagtacggtgaccgcagcaacaacgaggcgctctcactgcgcggcgatggccagtacgcccagatcgatgaccagctgttcaaggatgcgggcgactccttcactctggagttcgcgtccaagactcgtcacgacgacagcggcaagttcttctcgttcatcgtcggcaaggacggctcgaacgacgccaacaccaccgatcaggccaacgccaacaagtacctgatgttctacaacagcaagaccgccatcaagggcgttatctccaacaacaactggggtaacgaacagggatccaaggtcaccgtttccggcaacgacaacagctgggccgattacaagattgtcgtggacggcaccaaccttgccgtgttccgcaacaatgccctgatcattttcaaggccaacaccggcatcaagatgagcgatctcggtgcgaccaccgcctacatcggcaagtcgttctactccgtcgatgagtactggaatggtgcaatggatgatatcaaggtctacaggggcgctgacctgaccatgccgaccgccgttgcgatttccggtaccggtgtggtgaacaacaagctcaccctgattgagaaggactccaccaagctcaccgccaccgtcactccggacgacgccgtgagcaagaacgtcacctggtcctcctccgatgagtccgtggccaaggtcgccgcagacggtactgtaaccggcgtcaaggctggtactgccaccatcaccgccaccactgagctgggtggtgtgaaggccgaactgcccgtcaccgttgagccgatgaacgcccagaacgccgccgcagccgacctcgatgccgcgattgctgcgctgaaagttccggcggccgagaatctgccgctagtcgccaagggcaccaagaacggctcggcgattacgtggaagtcctcggacgagaagctcattacgtccactaacgagaagtacgaaaacaagaccactggtgccgatgacccgtatcgtggtgctggcatcatcaatcgtccggcctacggcgacggtgattccaagccggttacgctgaccgccaccgcttcctacaacggcggtgagaaggtcaccaagaccatcgaggtcactgtcaaggagaagacccgcatcgcgcctgacaccggctatgcggccgtcacttttgagagcgacagcaacggtggagaaaaggcctgggtggcttccactgagaagaacgatttcttcacgtttaagactcgcaacaatggccaggcggtacttaccaatgatgcagacacgggtggcttgcgtgacatgttcgtgctgcgttcccacgaaggcgacaagtactacctgattgccactgatctcaaggtctcgtcaatgggctggagccagaaccaggttaacggttctcggaaagttgaggtctacgagtccaccgatatgatgaactggacccgtaccaacggcgacggcaacggcggcatcaccatcaacacgccgaacgccggtatgacctgggcgccggaagcttactgggatgatgacctgaacgcttacgtggtgttcttctcttcccgcatgttcactgatgacacccgtaccactccggtcaagaacgacaaaaccggcaatagctcctatgctcaggtgcgttacgccatcacccgcgacttcgtgaacttcaccgagccgcagatgtggcaggacaccggctactcgcgcattgattccaccgtgcgtaagatcggtggctactactaccgattcaccaagaatgagcagggcggtgccgctggcgattacatcaccactggtaagagcatcttccttgagcgttccaaggtgctgactgcaccgaccaccgaggcatctccgggccaggacccgaacaccggttggcagctgctcgagcaggcgttgctgccgttcgaaggaccagagaccatcaagctcaacaaggatgacgaactcaacacgaaggacgacgacggctacattctgctgtccgacaacttcgcctaccgtgcatttatgaccacgggtgccgagctttccaagaccacgtgggacaacccgatgaccaagcgttacccggacttcaacaacgaaaagaagccggtcaaagccgagccgggcgctcagggctacatcactcagggtgctaacggcggtctgccggacaaggtgcgtcacggtgcgttcgtgaacgtgcctgagtctgtgctcaaggtgacgaagtcctggaccgctgccaacccgacgcacatcgaggctgttgactccaccaccaaggccgtgtacaacgccggcacccgcgagctcaccgccacggtgaccgccgccgataagggcacgctcgccggttcggtgaagttctctgctggcgactggtccaagaccgtgaagctcgacgccgaaggcaaggccactgtgaccctcccggccagcgtctctggcactgttgcggttgcttacgacggctacaccgatggtttggtcaatccatccgatactacggttgacggcattgaacagggcaaggtcgatttggctgagctcaacaagcagatcgccgccgccgaagcgctcaaggaatccgactacacggccgattcctgggccaagcttgccgccgcgctgaagactgccaaggccgcgctcgccgctgagaatcagggcgaggtcgataccgccgcagccgaccttaagaccgcaatcgaagccctgcagaaggctccgaccaatccgggcgaaggtgacggagataagggcgacggcaataagccgactaccccgaccaccggcgacaagaccaacgtcaacaagcccggcagcgcgctgagcaataccggtacggccgtgctcggcctgggtggtgccgtggtagcactcgccatcgccggcatctccctaaccctctggcgcaagcgtcgcgcctgagctgctacggcaaccaagccccccctctgacgagggggggctgtcagccgaaggctgactgggggagagaccgcggcgaagccaccgaaagaacggcatggccttcggccgattctgtatcccgcggctgccgccgcaggtctctcccccgactgcctaacggcggccacaaaacttcgctccataactgaaggcgcaaccacaatcaaccctatcaatgaggagaaacatgggaaagctgatacgaaaggcaaccggactcacggtcggcatggcaacactgctcgctggtctgttgctgccgatgacggccagtgccgagagcgcatcgccaatcgatgccagtccgatcatccactattcattcgataacgcactgacgtccaagaccatcgctaacgagggcagcgcggccaacagcgatgccaccctatccggcgacgccacggtggccaatggccagatcaacctgaccggctcgcaaaccattagcgtgccgaccacggccatcgccggtaagaaggacgttaccgtctccatctggctcaagaacaattacggcaacggcaataccgccgccgcgtacatcggcgcggccaagaccggcaattatccggccaacggctactggctgctcaacccggccaacccgagtggctacgcgaaatccgtaatgaccaatgccactgcggccgacccgaataacagcccgtggggcaccgaagtcggccctggatcgacgaacgccgccaccaccggcaccaaggccaccagcgatttggctctgtacaccaccgtcatcagcggcaccaacagcaccatgagcttctacctcaacggcaagcaggttggagacgccacctacaccattccggccggtggcctgaccaattacggcggcctcgtcgcctacattggcaagtcctcctacgctgacccgaactccaagctcgacgtggacgattacgccgtatacgacactgccatcagcgccgcagacgtgaccaagctgtatgacgctcaggtgctcgacaaggccgaggccgctgtcaaggccgctgtgcccgcatccgctaccgaggacttcgcgctgccgaccagcgccgctggcgtgagcatcgcgtggaagtcggacaacgcagccatcgccgttgacaacgctaccggcaaggccacagtcactcgtccggccgcaaccgcagctgatgccgaggtgatcctcaccgccacgtttggcaacaacgccaaaaccgccgactacacggtcctcgtgccgaagcagctctccgatgccgagcaagccaaggccgaccttgacgccatcaccatcgaggactccgacgacatccgtagcaacttctccgtgcccaccaagggcgacaacggttcgaccatctcgtggggagtgaccggtggcaaggatatcgccacactaggcgaaggcgtgagcgacaaatctcgaacggtcactgttaagcgccctgccgccggtagcgatgccgccactgtgacgctcaaagccactgccaagtacgataccgccaccgaaacgaagaccttcaccgtcaccattcagccgatgcctgccgccgaagagaaggacgaggcctacgtgtgggcgttcttcaccggcgagggcgtgggcggcgagaaaatcagcctcgcggcctccaagggcaacgatgcgctcgactggaacacgctgaacaacggcacgccgatattcacttccgagtttggcgagaagggtttgcgcgatccgttcatcatgaagtccaaggacggcgacaagttctacatgctcgccaccgatctgaagattgacggtcgtgcccccctcaacgggctgaatggctttgctggtgcacaggctaacggttccaagtacattgagatctggaagtccgacgatctggtcaactggtccaagcaaagccacgtcaaagtgagctctgattacgcaggcaacacttgggcgcctgaggcctactacgacgaggaaatcggcaagtacgtggtctattgggcctcgaacctgtacgacaacaccgacgagaacagccgcaagcagctgacctacaaccgcatggtgtacgtcaccaccgatgacttcgtcaacttctccgacccgacagtgtggattgacgttgatcgccgaggtggtgcaggcagtggatccatcgatgtgaccgtgcaaaaggtaggggatacctactaccgcatctacaaagatgaaaacacgatgtctttgcgtcaggagaagtccacagatttgactgccgcaattggtggtgccggcgtgaagaactacgccgatgcgcttaagggtagtgcatggagcgaagttgccacgaacatcggtaaaggccaggctaacggttacggtaaaaccttcacttccggcgaaggtccatcgctattcaaggccaacgatggcgatgtgaacggctaccagtactacctgttcgccgaccagccgagctatcatcaaggtccaaaccactatgtgccgatggcgactgaggatatcgccagcggtcagtggaccgttatcggcaataagatgcctgaggcgaacttcccgaccaattccgatggcggcaagccgcgccacggcactgtgctgcccgtgacccgcgcccagtaccagaaggtgctggaggcatacgccccggctgtggctgtgaagtccgttgacgcgctgtctgccgagacaacggttggtgtggctccgacgctgccggagaccgcgcatctgactcatgcggacggttccgtttctgacgttgcagttgagtgggatgccattgacgcatctttctacgccaagaccggcaccttcaccgtcaagggcatcacccaagacgattcccgtatgccggttgaggctaccgtcattgtgaacggcatcaacctctccaaggcgaccgtcaccgtcgaacccaacgagttcaccgcagacggcgctgccaaggaaccggccgtgaccgttgtactcgatggcgcgacgctcaaggaaggcgccgactacacggtggcctatacgaacaacgtcgaacctggcactgccacagtgaccgtaaccggcgctggcaagtactccggtactgtctcggcaacgttcaccatcaaggccgccgagcccggctccacgctggacaagtccaagttgcaggcgcttgtcgataaggtgaagggctataacaaggctgattaccagtctggttgggatgctttcgccgtcgcgctcgccgacgcgcagcaggtgttgcagaactccaccgaccagcaggaagtggacaaggcgctgtctcggctccagtccgccgccgacaagctggtcaagaagtccggcgactccggcaagaccgacggcaaggacgacggcacgcaaaagcccgccgccaagccgggcagcgctctgtccaacaccggcgcctcggtgttcggtgtgggtatcaccgcggtcatactgctcgccgccgccggcgccgcctacgccttccgcaagcgccgcgcctgaactgtttgcagcgtagaccaagccccttctggatgagtcgagctgtgaagcaagcagcctactggattgtttgcttcatggcgcggccccatcagaggggcgtatcgcacgttcgtccgacgacgctgtcggacgcataggctctatagccccatagctccaatagccattaccgaacttcaccactcaacatctagatctgctgcgcgacaagcagtatcaccgcgcgcaaggaggaaaccaatgacaaccaaaccatcgataggcaaacgcctgctcggcgcgatgctggcagtgccgatggcgctcgccggcatgggaatcggcgcgaccacggcggtcgcggccgataccgttccgaccaataatctcatcgccgcctacgacttcaccacgaagccaagtgacggcaagaccgtggccaacagtgcgccgaacgctacgcttggcgcggccgaagtacagaactccgccgactcgctttgggccgatgatgccctcaccctttccggcggtgccaagaccggcaccggcgactgggtcaagctgccctcgaatctgctgtccggcaaggacgccgccacggtgcagttggaggtcaaagcggattccagcatgctcaatgctttccatttcctgtggaacatcggtaacgacagctccgatacggagtatttcttcgccacgctcaactgcggcagttcgcgtaacccgctcgtcggcctgaaatcgggcggtacggagacgctcgtgcagtccagctcctgcgtggccaaggccgaccaatggttgtcggtgaccgccaccattgatggcaccgccgcgaaactgtacatcgacggcacgcaggtggcatccggcaccgtgccggccaaactgtccagcgtcaaggaccagtcgctcaacaccatcggccgttcgccgtggcccgacaacctgttcaagggcgcggtctcgaacttccgcgtatacgatgccgcgctcaccgccgatcaggtcgccgcgatcagcactgccgatgcctcaattcatgccggtgaactcaccggttccgtgctgaacggcatcatcatccccacgacggtcgacgatccgttcatttcgctgcccactgcgaacggcgtgacgtgggcgtcctccgatagcagcgtcatcgcgactgacggcacggtcaaccagcccgccaagggcgaggcagccaagactgtcacgctgaccgccgccgtcacggtccgtggccagaccgctacgaaggaattcacggtcacggtcaacccgaccacgaaaactgccgctgaacagctcaaggaagtcgcggccggctacgtgattccgtccgtcgtgcgttccggagacgccctcccggcggctgtgaatggcactaccgccacggttacgtccactaaggacgtagccgtcgaggatggcaagatcaccatcgatggcgacgaggccacgaccggtaccatcaccgtcgagttctccaagaacggtctcgccggcatcgagcccattaccaaggccttcaccgtaaaggtgctgcccgccgcgaagtccgcgaccatcgccgcctacgatcgcaacgccaccggcgagaatgaggccaacaacggcgacgtcgcctacagcatgcacctcgcgctgcagaacgccgacggctcgtacaccccgtacaacgagaattacggcattttcttcgcacgctcgccgaaggcgcagaagctcaacgagaacctcgacggcaatgactatcgcagtctcaaggatccgagcctgttccgcatggccgacggcacctatggcgtgatttccgtgcgtaccaaccgcggcaccgccaccggtgactccaccgcgaagtccagcgtgctcatcgccacctccgaagacctgctcacctatagcgaacaggagaactccggttccatcgtcgaccttggcgagaccaacggcgtcaacgctccgtacgccgtgtacgacaccgccagcaagcagtatgttgtcggctgggccgatgacaacggcgtggccaagtacaccacgttcgattcgctcaagggctccacatccaagcacggcagcgtactgtacggttccgtcgccaagtccggcgtactcgccgccgacggtgtacagggcatcgcgaacttccgctccggtgccaccatcgcggtggacgaggccacggtgaaggcgctcaacacccgttacggccgctctgagaacaccggcacgagcaatctcactgacatcaccgtcaagaagggcgcctcaatcgatgaggtgaccgcgcaactgccgaagaacgtggacctcacttactccgacggttctaccggctccctgccgatttcctcatggaacactgagggcatagatctgacgaaggtgggtgattacactgtcaccggcaccgtcaagcagaccgaataccagattccgttcgctgaggaccgcgccgatccatcggtgtataagtggcagtggacgcatgaggccgacggcaaggaaatcaccgaaaccaagttcctgatgatcgcttccaatgacatccaaggtgacgtcacttggcagcatggttcgccccacatgccgttccgcatggccgacacgatttccggtctcgccgacgagccgggcaacccgaatgccctgattcagtcgaacggctacaacaacaaggaggtgtcgctgctcaaggctggcgacaaggactccgagggtaatgccatcatgcacagcttctgggctccagaaattcatgagattgatggtaggctcacgattctgttcatggccggatacggcaacacatggtccaacggcaagtcggtgtacatgcagctcaagcaggatgccgacggtcacgacctcgacccggccgaccccgataactggactgtgccgacaccgatctaccgcaatgacgcctcgctgctcaacggtaacaagcagctcgcagccacagcgtccggcggagtgggcatgtcgctcgacatgacctatttccaggatgccgacggcaggtcctactacgcctggcagcagctcggcgccacctacatcgccacgatggatccgaaggacccggcccatgtgaccagctccccggtgcgcatcgtcaccccggagtatgcgtggaacgccgccatagccgaaggtccgaacgtgaccctgcgcgacggcaagctgtacctcatgttctccggttccggcgtgggtaagacatacaccactgggctggccgtagcggatgcctccggtactgacctgaccgacccggccagttggacggtgctcaactacccgattcagaagtccggtccgttcaacggtgagatgcagctcggcaccggtcacggcatgtggagcgaggacgaagatggcaaccagatctacgtgttccacgcctatgccacgaagaatctcggatccgtgaatgctgccggccgcgacatgttcgtgcgccgtgtgcactgggccgccgacggcatgccggtgttcgacatgagctcttccgaggagctggcctccaagaccgtttccgtgacagtgaaggtggtcgacgacacggttacggtcgacaagaccgacttgtccaaggcgctcgcgtccgccaagcagctgcgcgagtccgactacaccgccgcctcgtggaaggcgttcgccgcagcgttggcctccgccgagaaggtttatgccgacgagaacgcttcgcagaaggacgtcgacgacgcaaccgccgcgttgaacaaggcgcaggccgcgttggtgaaggtcgacggttccgattcgggcgatggctcgagcgattcgactaagccgggcgacggctcgagcattgacgctggtgctactggtgataagacgggcaacaagctcggtctgtctaagaccggtgccgccgtactcggcctcagcggcgtggccgtggcgctcgctgccgccggcatcgccctgaccctccagcgcaagcgccaggcctgagcggcgtaagcctccaatcgcgaaatcggcccgtgtggaggtgtatttccgagttgtagggcaatggctgaagtattggccgttgcggccgatgagagcccgttggtattccgccattttcgggtggttgatcggctctgggagtggcgagtacccgggcgcgtgccctacaactcggaaatacgctcggtacggagccgtttctggttcacgggatttcggctgaaaatcccgtgaaccagaaacttacagaaatgcacatggccggccatcgagttcggcttgattccaatcttttgcgtgtgcgattgcacatgtcttcagttcacgggatttaccagcgtgatcccgtgaactggataacgcggacatgcaggccacgcggctcaacaagccaatattgcacacagatgatgtgcgattttgtttgttgtggggtgctgagaaggggtaaatgttcattcggggagatgaaaccggttttaagaggggtgccgggtatttcaggtatggcaaggaatcagcatgtgcgttaccgctttcgcgtcgtcgctcaaagcgtgctcaaatttaggtgaacgctcacattagaattgtgagtgcttacagaaacctgtgcgattgcacatcggtgctcctgttcacgaacggtgtcgttcgtagggatttccggtggccgtcgttcgggcggaagtgggtcgcgctggcgaacgaagaggctccggcgaagcggaagcaggagcgagaagcggtcgataaaggagcgaccgggtgtcactcgataacaattcgataacaaatattgcgatggcgcaacgatgatccatcacagtattgcaaagaagcaaggacccaaggaaggaaactcagtgaggagagttacacgattggcggcctgcctgacggcggtgtcgacgttgggcgcggggttgatcatgccgatcaccgccgtggccgacgacgcgacgcctgcggtgcagacgaccacgaccagtgcgaacgtcagggcggcggccaatacagcgacggctgacccgattgccagcttcgatttcaatagcgacccggacgatggtgcattcgccagtgctcagggtgacgctaaggccaccgtgcaaggcacggtggatctcgtcaacggaaaagatgacgacaacggcaaggccgcccagctcggcagcggtttctggctgaacgtgaccaagtccgatggcagtgcactgctcaacggtcttgatgatgtgacgatcagctacgacagcaaggcggctgcgaccggtggccagtggactgtgtttgccgcgccgaccgccggtgcggtgaacggcagcgcccccacctacgtcggtgtgctcgaccgcaccgacaagacccgcgtggaacgctatctcaacggccgcgcatccgacatcgccaccatcgacaagaacaccggtacgaaggatgcttggaagcatgtcgatctcgtcatctccggcaagaccgcgaagctctatgtcgataagaagttcgtggcgagcaacgtgaacggcgaggatctcaagagcattcttggcggctcaggtggcgtgctgcaaatcggcaaaggcaactggggcaacggtgaatacttcaccggtttgctcgacaatctcacgatttatggctccgcgctttccgcggccgatctcggcatcgcatcgcctactgcaatcgagatctccggttccaatgtgaaggacggcaagctgagtctcaaggaaggcaactccgcatccctgtccgcaaccgtcacccctgaaggcgctgagcctacggtgacatgggaatccaataatccggctgtggctactgtggataccaacggcaaggtcaccggcgtgaaggccggcaccgccaccattacagcggcttccgaagctgacgccgccaagaccgccgagctcaaggtcaccgtcaccgaggtcaaggccgatgacgcctacggctacgtgatggtccacttcatcgaaaacaacaagggctacgccgagaagatctacctcgacatctcgcgcggcgatgacgccacccagtgggatacgctcaacggcggcgagccgattctggtgagtaacgaatccaccaccggcgtgcgcgatccgttcatcgcctacaaccccgagtcgaagacctactacgtgctggccaccgatttgcgtgtgttcggcggcgataatgccggttggggcacgtgggctacaggttacagcaccaagttgcatgtgtggtcgtccaaagatctcattcacttcaacgacatgacggaactggagaccgccaccgccgacaagtacactgccaatccgaacaagagccagacgctcaccgattccgtgaccggcaagaccatctccgagatcggcatggcatgggctcctgaggctacgtgggtgccgaacttctatgatctcaacgacgacggccagctcaacggttccgataaggacaacccgaagaaccagcagggcggcgcattcgttgtgtattggtctgtctccgccaaatacgatggcgagaacagtcagcccggcaagaaggtgactcacgtgttgtgggcggccaccaaggacttcaccaacgagacttacatgtttggcggcgtcttcgtgcctaacagcaagtacaaccgtggcaacaccatcgacaccacgatgctgcagaacagttcccgcacataccgcaccaccggctccggcgtgatcttcatggaatacaccgatcgtgccgattggtggcgtgccaacgatcagggccagtacgcgaccgacccggccaagggctgggtgttgcgccagaccaacatcggacacacgctcggcagcgcgcaggaaggtgccaacggtttcaaggtcaacggtgagaacaagtggtacatgttcgttgacaactatggatctgtcgcttccggtgcccgctacggctacaacctactcgaagccgacaacctcgattccgagaatccgtggagcgtcctgaaggccgacgactacttcctcaccgccaacaccaagcacggtggcattgtttcgctcaccaaggcccagtacgacgcgattcgcgcggctgatgccaaggcttccgacaacgccgacctgaaggccgaggatgtgacggtggataagggttctgccgatatggacatcactgccaagctgccgaagacgcagcaggtcactcttgccaacggttacggcactgccaagcgcgacgtgacgtgggacgtttccaacgtcgacacctccaagcccggcgaatacaccgtcaccggcacggtcgacaccatcggtgccaacgagaaccattggaagtggacgaacgccgccggcgagtcgaagaccgacgaggacgacctcatcaactccggtgcgaacgcgaacaacagctggaagcagaccggtggctttgtggacaatgaaaccgccaacaagaaccgcacgctatacagctccaccgccatcaccgtgaccgctaaggtgaccgtgaccggcgaaaccgagccgaccgacccggatctgcttgccgacttcacgttcgatgatggcgataagacctttgacggcggcaacgcgacgggcaccacgcagggcaccgccacgctcgccgacggcaaggacggcaaggccgcgaagctcagcaagaacttctggctcaacgtcaccgccaagaacggcgacgctctgctcaagggcaagaacgacgtgaccatcagctacgacgtcaagcccgatgcctccaacaacactggctggaccttcttcgccgcctccaacgccaccaagcaggagtacggcaaggaacactacgtcggcgtgctcgacaagaccaccggtattaccgtcgaacgctacaacaacaacgacggcaagcgcgattcctccggcaacgtctcatacaccaagacgaacgccgactggaagcacgtcgatatcgtgatttccggcgcaaccgccaagctgtacatcgactccaagctggtagccgtgaacaacaacggccagaagctcgccgacatcctcggtgctgatggcggcgtgctgcagatcggcaaggccaactggagcaacggcgagtacttctccggtctgctcgacaacttcaagatctggggcaaggccctgagcgacgacgagcttggcgtggaaagcgcgaagaccgactacgccgccgcgctcgccatcccggcgcaaatcaccggcgacctgccgagcactgtgctgggcaagacggttacttggtccgcgaccggcgacggtgcgaagctcgtagccgcagacggcaaggtcacgcagccgaagtccggcgagaaggccgtgaaggtcaagctcaccgccaccatcgacggcgtggataaggccatcaccgccgaatccgaaatcctcaacaacggcggcgaaatcgcttcctacgtcaaggatgtcgatcgctccgaccagaacggtgccaagtacgacccgctcgcctacaacgacgatcgtcgcgccgactcgctgtacgtggccgccaaggccgccgatggcagcaaatgggagaccctgaaccgttcgcagtcgattctgtcggtcaagtgggacggctcgcagtctgccaagccgaatgcgcagatgggctcgcccgctttcttccgtgcggaggacggtacccttggtgtggtttcctcgcagaacaacgccaccggtgcgatttacgtgtgggatggcaagggcgacggtgccacgttcaccaacgagcgcgccatcaccgtgaccgacagctccatggtcaccaacccgcgcatcgtctatgatgccgcctccaagggctacaaggtcttctggaccgatggcctgagcggcgaaggccgtatggccacgctctccgacctgactgccaaggcaacggtcggcgagacgctcaaggccgacgcggttgcgatgggtgtgggcgacgtgaccgaaggtctgcccgcatgggccggcgaaggccagacccgcgcattcgctgtgagctcctctgaattcgatgcgttctacaagaactatgtcgatctgcagaacaccggcgttaaagctctgggcggcgcaaccgtggagaacggtgcttccgccgaggacgtcaccgcagcggtttccggaacgcaggccacaatgacctacaacgacggctccacgaagaccttcaacgtcgactggaacgccgatgatctggccgccgtggacacctcaaaggccggcacgtatgaggtcaagggcactgttcagcagaccaccgaggccatgtacaacgacgctcgcgccgatccggacatcttctacaacgaagacgatggctactactacctcaccggttccacctatgaggtaaagtccactgattcgaccaacaaccagaaggacagctaccgttccatcggcctcaagcgcgccaagaccatcaacggtctgaaggatgctgaggaacacatcatcatcaagccggagaacggcactccgggccacgaagaccagtaccccaactcgttctacggttggagcgcgttcatttgggcccaggagttccacaagattaacggcaagtggtggattgtggccggcttccacaggggtgcctcgtccacgaacggtggctggtgcaacaacaccatcctcatcccgtacaccggcgacgagcggtccatcaaggatggcggattcctcgaggccgaaaactggggcgagccgaccgtgctggaaggcgccgcattcgacgtgacgtacttcgagcgcgaggagaacggcaaggcccagggctactggctcttcccgaagagcgcaggcctgtaccttgccaaggcaaagatgggcgatggcgtcactccgctggtggatggcagccttgagcacatctatcaggccagccagcagttcgagtacggcaagtatgcgcctacccccggagacaactctgaaggttctgatcaggcaatcgtagaggcaccgttcatgttcgaacatggcgactacgtctacattgcctatgcgggtgccacggtggataagtattacaacaccaacgtgatgcgtgccgccaagaatgccgacctgcaggatctgtcgagctggaccacggccgacttcccgtcgttcgacaccaacgacacctacaccggtacctacggtgcggatgaggcctcgtacgagcgcaagcaggccggccccggccacatctcgcttgcacatgatgaggctggcaacatcgtcatggcctaccacgcacgcccctacccggaaattcactccggttccgcggcgggtggcctgttcgatcaggaccgcaatacgtggggcaaggccgtgaacgtgcgcgccaacggcatgctcgacatgtcgctgaccaaggatcaggaggtcgctccggccaaccgcacggtgaccattacggtgaccgtaggcgagcccgatacgccggttgagccgtccatcaccggcatccgcgtcaagagcgagccgacaaagaccaagtacacggtgggcgagcagttctccgccgatggtcttgtgatcgaggcgacgatgtccgacggcacggtgaagacgctcgatgccgccgactacacggtcggcgacgtggacatgtccgctgtgggcaccaagaccgtcaccgtcgcgctcaaggccaacgatcagctcaccacgtcgttcgtggtgaccgtgagtgccaagaccgagcctggtaagcccggttcgggcgacggttccggcgatggtgcaggcggcgataacggtaacgctggtacgggggcggactccggtctgccgtcctctggtgccgccgtgctcggccttggtggtgccgtggttgtgctcgccgttgccggcatctctctcactatctggcgcaagcgtcgcgcctgagcggatccaaatgctccctctcagtcggcttctggcggacggagagggagcacctagtatcaccataacttcaatcttcaatccataactgaacacaaaaccaaaacccacaatcagaggagacacatgggtaagtggaagaaagcggtggcagctcttgcagctgtcccgatgctgatggcgttggcgccagcagcaaatgcggttgaatcggatcccaccgattcatcggccgcgcagcgggcgctggcagcagccctgaaatcaaatgccaaggcagcggcagacagcgatctgctcgccagtcttgatttcgacaacgtcgctgcaggcgctactggcactattgtcgatgacaccaccggcaccaaggcgaccatcaacggtgctgccgcagtggctaccagcaaggacggcactgctgcagttcggctcggttctggattctggctgaatgtgactaagtcggacgattctgccgtgctcaagggcctggatgcggtcacgatttcgtacgattccaagtccgccagcaccaatcagggctggtcggtatttgcggcaccgaatacgaatgcgcagacctatcagcaagagcattacctcggcgtgatggatcgcaccacttcggtgaacgttgagcgttacaacaacgctggtaagcgcgacaccaccggcaatgtgagcaaggatggtctcgccagccagtggcgtcacgtcgatttggtcatcgacgaggccgcttccacgctgtacattgacggtgagcaggccgcaaccgtagccccagctgatggcgcgagcttcgctcagctcaccgatattctcggcgcagacggcggcgtgctgcagatcggcaaggccaactgggtgaatggcgaatactataccggcgcacttgacaacctcaagatttacggctctgcgcatactgctgaccaaatcaaggaagcctacgattccacgaagtccgatgccgccaaggccgacgctaatgcgctgaccattaacaacggcagcactgatgtgtattccaacatcacacttccggccaagggctcggttaacggttccgcgattacgtggaaatccagcaacgcaaaggtcattaccgatgcggcagatggtgacatcgcagctggtgtcgttgctcgtcagaaaaccgacaccaaggtgacgctcactgccaccattaccgatgctgacggcaacacggaaaccaaggaattcgagctgaccgtcaaggccgccgtcgaacagccgaagaccacggactatctgtttgcgcacttcaccggcaccgaaggtagcgctaccgacgagcagatgtacttcgccaccagcaaggatggcctgagctggcatgacacccgcgagtccggcgatccggtactcagctggaacaacagccagaccggcaactctcgtggtaaggacaacggcgtgcgcgacccgtatctggtccgctctccggaaggcgacaccgtctacctcatcgctaccgagctgagcatccataaccgtggcggttggggcgcggccaccgctaccaccaatggcagcaccaacctaatcgtgtgggagtcgcatgacttcgtcaactggagcgaaccgcgcgccgttgacgttgcctctcagattccgggagccggcatggcttgggctccggaagcctactgggatgatgtgaacaagcagtacatggtgtactgggccactgcttccgacgcggacaacaagtccggcgatcgcaccaatatgtactactccaccacgcgtgatttcgtgaacttcacgacgcctgtcaagtggatcgaccgagtcaagtccgttatcgataccacgatgattaaggccgatgacggctattactatcgtgtgtccggtgacacgtacctcggtgttgagcgtagcaaggatccgtatgccacaacgctcaccactggtgacacaattgcgaatggttactacaacactgacagtgatccgaaccagtggacgcttgtcggtacattcggtgacctgactggtaccggtctgaccggtgcgcagctggaaggcccggagctgttcttctacaatgaagatgacgtgcagaccagtgatgcgggcaagaagatgctctacggtctgatgtgggaccagtactcagccggtaagggttacaccccataccgttctgccgatttaggcagcactgataaggctgattggggctttgcctctgatgtgaacttcggttcgctcaagaagcgtcacggcaccatcctgcctgtcactgaaaccgagtacaacgcaatcctgaaggcattcgataagaacaaggacaccgagccagtcacacccgatgaagacggctccggtccgattgccgagtatgacttcgaagacagcaagggtaccgacaccactgagaacagcaacgacttgaccttcaacggcaacgccaaggtctccgaggatgccgaaaagggcaaggtgcttaagctcgacggctctgacggcacctacgccgagttcccgaagggcctgttcgatggccgtaacaagctgactgtgcagatggatgtcaagtcggagatcaataaaaaccagttcacgttcgctttcggccagaactccaccaagtactacttcctgaagtacaacaactccggcgagctcgccagccgcatcaccaccaactcgtatggtgcggaggacgcggctaacgctacgttgtctggcaacggcgcatggcatcgtgtcacggtcacgttggacgacaacgtgatgaccgtgtactctgacggtgcgcaggtggctcagaacaaggcgaccaagaacaaggtcaccgatttgggtaacgatctgctggcctacttgggcaagtccttctacaacgacccatacttcaagggttcgttcgacaatgtgaacgtgtggaaccgcgcgctcactgctcaggaggtcgagaagaccagcccgattgccctgcagggtatttctgtgggcactgtgccgtctgacccgaactcgctgcgtggcactgacgaccactctcaggtgcgttccaccctcgactggtccgcgaagaccgtcaccaccgtgctcaaccgccgtggcgacgcggccaaggtgcccgtcaaggtgaccgtcaaccgtggcgacgactccatcaagctcacccttgatggtcaggcgttcaccaatggtggtacggccgacctgactaaggaccgtactttggtcgttgatttgggcgacggtgcgccgcagacctggacgctgaagaaggtcaccgtgggcaacaacccggtactgcccggccagtacgccgacccggacatcgactacttcgacggcaagttctggatctacccgaccaccgacggcttctccggctggagcggcaactacttccatgcgttcagctccaccgacttggtgaactggaccgacgagggcgtgatcctcgatgtcaataaggaccaccagccgaccaccgatggcgatgagaacaccgccatctccccgtggtccgtgggctccgcgtgggcgccgaccatcgagaagaagaacggcaagtactacttctactactgcgcgaagttgccgaacggtacatccgccatcggcgtcgccgtggccgacaacccggccggcccgtacaaggccgccgaccaaccgctggtcactcgcacgatggaaggcgtcaccgttggacaggccatcgacccgtccatcttcaccgacccgaacaccggcaagtcgtacatcctgtacggcaacggttcgcccgccatcgccgaactcaacgacgacatggtgagcatcaaggccggtacggtgaagaagctcaacggtctgaacggcttccgcgagtccgtggtcgtcgcctaccgcgacggcaagtaccactggacctggtcgtgcgacgacgccaactccccgaactaccatgtgaggtacggcgtctccgattccatcgacggcaccatcacctacaagggtgtgctgctgcagaaggattcctccaagaacctgcaaggtaccgcgcaccagtccgacgtgcatgtgaccgacgcggacggcaacgaccgttggctcatggcctaccatcgccactacacgccgctcggcgtgttcacctccggcctcggctaccaccgtgaaaccgccatcgacgagatcaccttcgacgcggacggcctgatgcagaccattcacccgaccgacgaaggcgtgtccattgagatggccgatacgacggcgcttgatggcgcgattgaagcggccgacaagctcggcaccgatggctctgcttacaccgaggccagctggaaggcattcgaggatgcgctcgccgcagccaagacggccaagcagaccttccttgactccggcctgtctcaggctgatgtcgatgccgccgccaaggccctgaccgacgcgcagaatgcgttggaggagagccagcccgagccggagcacccggccgcaggcacgatcctctccatcgccgtgaccgcgcagcccgccaaggccgagtacaaggttggtgaagcgctcgacgttgccggtctggtcgtcaccgcgaccgtggccgatggcaacggcggctccaccacccgtgagctcgccgccgatgagtacgagctgctcggcttcgactcctcgaaggcctccgacaaggtgaccgtgaccgtgcagtctgtggccgattcgaccaagaccgccacgttcaccgtgaaggtcgttgccgacgagacgccgactccggatcccgatctggccactgaggaagagctcaagcagctcgaagacgccattgccaaggccgaagccgagaagctgaaccaggacgattacaccgccgattcgtggaaggcctacgccaatgcgctgggccaagcgaagaaggtgctcgccaaggagaacgccacctccaccgaggtccaggatgcgattcgtcacctgaccgaggcccgcaaggccctcgtgaaggtctccgctgatggcaagaagccgggtgccgtcatctccgacactggtgtcgccgtcttcggcgtggctggtgccgtggtggtcctcgccgccgccggtattgccctgaccatctggcgcaagcgccgtatctgacccctcatttgcaaaaaactctcactgagcactcctcagtgagagttttttgcaatagggggggtgttcctatgtttttgtcaactccttggggagttgacgtgtcgggattagccatccaaacccacctctaaccacacgccatacacaccaaaatgcgaagagccacataaccaaagagcctctgccgggaatcaaccggcagaggctctttgcatagagaataatcgcaatcagtaattgttatgagcgatccagtagttgtacgctgcgacgatgccgccgtagcgctgctcgcaatagctgatgaaccacttgaactgggtcttgtagttggtctgccagtccgcaccggcggaagccatcttgctaccggggtaggcctgacccaagccataagcaccagacgtggggttggtggcggtggggctccaaccggactcgtggttgatgatgtagttcgcagcggtgaagtctgcttcgctatacccgttgtccaacagatactgatgcgcccaggactgcacttctccagccggaacagtggtgccgagatcggccgacgacgatgacttggtggaaccagtgcccaccaggatcaccttatccaccggggccttcttgacccatgaggcgaatacgttggaagagatgaccttgtcgccggctcgcttgatcagcgaggtggtctccataatgcccttttggccctcggtctcgaccttttcctgacccttgggcaggctgctggtctccttgcgcacttcattgaaggcgatctcggtatcgttggtctccacatcggcatccgcgcgattaatggtgaccacggtggcctcggtgaccttggatttcagcgagggagatacggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgcgccgagcagacctgccgcggccaccacagccgcgatcttcatccactggcgcttgttcaacggtctgagcatacgggtcggcttggcatgtctcgtcattgcgctccttgatcggatttcacactgcccaccatgataggcggcgcagtggatgaaggaaaatcaggctcaggcctgctggtcggcaccggactgggcggccttggcggcggccagatcgagtgccttggcctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatcaaccttgacgaaggcgatgttcgcgttctccggctcgttggaggccgcctcgaaaatcgggccgaacgcgcggcacgggccgcaccaggtggcccagaagtcaacgaacacgatttcgttgtcggtgatggtcttctcgaaatcggcggaggtgatggcggtggttgccatgatgttcccttcttttgtgttttccttggcatcgccgtacggccctcgtgcgtggccgccgggcgattgccttattcatgcaatacgtcttggcgcttggggccgtgcggttcgtggccgccggctccctgctggctaccagcttcccagcaccacccaacatttgtgtcgtattttccgccgccggccaaacgtttcccaagatttcgccggaaggtgacgcgtggcgtgtttttgcgcgcaataatgggatgcatgccagtcatgaatgatgaagtgcccgacgagggcgattatgatgccggccgtggccgcggcgaattcgacaacatcacgcccgaggacttcatccacggaggcggttccggtcacggcaacccgccgggctggctggggccgtccgacatcaaccgggcgcgccatcagatgcccatcgcgtatgtggagatcgtgcctgtgcgcaccgatgagatgggccgcatctcccaagtgggctcgctgctgcgcgtatccgaagacgggtcgatcgagcgtacgctgattaccggccgtgtgctgtaccacgagacgttgcgcgaggccatcgcccgcaatgtggccaaggatttgggcgatatcgccttgccgctgctgccgatcgggctccagccgttcgccgtggccgaattcttccccacgccgggactaagcgaatactacgatccgcgccagcacgccatcgcactgtgctacgtggtgcctatcgccggcgactgcaagccgcaggatgagacgctggatgtggaatgggtggatcccaagagcgacgtaatggacacgttcgtggcgcagatggtcaacggccatgggcgcatcgtgcgacaggcgttggcctgggccggaatctgacagttgttttgccttccgttggaggggatggcgcgtagcgacggagggcggtccgcgttgagaccgctcccagccgactgtgccgacagctccgccagtggggcgcgaatgtgaaggagtaacgacaatggcaatcgaattggccaatcatatctaccgtgacggcgaaggcgtgccggtggtgctgatgaacgcctacccggtggaccaccgcatgtgggacgtgtgcgcgaaggcgctcgccgacttcgccgatctgaacgacgtgccggacttcccgatctgggctccggacatggccggctccggcgcatccccggtgccgagcgaggccgattcgggcccccgcatggcgaacggcgcgtacagcgaagcgctggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgcgacacgatggccgcgtccgacggcgtgggcggggagaaccgactgaagatggcggacgccgccgaacagacgaactcggtcgaaccggtgatgcacttcgcgcaaccggccgatggcgattccaccgtcaagaagactcctgaattcatcgcgaccatgaccggctggatcaacgaacagaaccctgccggcctggcctggcgccagcgcatgacctacggacggtctgaactgggggcggtgccggaaacgatcagcgcgccgagcctggtggtatccggcgaactggacccctccagcaatccgagtgtgatgcgtccgctcgccgagcgaatcaccggcgctgaattcatcgatattccggactgcggccatttcagtgccgtcgaacatccggataccgtggcgcgagcactgctctcgctcgtcaggcgcgtacagagcgcgcagaagaacgcataggagacttcgatgaccgctgacattcatttctcgcctctggcactgacccatgcgctgccgttcctgccgctcgcacaaggtgacatcgactatcaggtggaccggcgcagcgaacccggcctgatcgacgagctgctggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagtcgggaaacatcaagggcaatggcggcgtagccgcagccaaaatcgccgggccgctcggtgtaccggattcggccgggcaaggtgcggacgatgccttcgatgattcggtcggcgcgtccgtacagcccttggccccgaaacccacgctgctgcaacaggccgtgacccggttcgactgggtggacctgcgcggattcgcccctcacgccaacgcgcgcgaggccgggcaagccaccagtgccatcaccttaagcatctggcacagccgccagcggttctgccccacctgtggcgcggcggtccggccggcgctcgccggatgggcgcagcgatgcaccaacgaggcggacggcaaccgtgtgctgttcccgcgcgtggagccggcggtcatcaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggcggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgaggaacatgcatgggtggaccgttcggtcgaccccgcaatcatcggcattaccgaatacgccgccgaccagcttggcgaacttgtgtttgtggatctgcctgagcctggcgcccgtgtggaggccggcgacgagatcgtggagcttgaatcctccaaggccgtccagccgctgatcagccccgtggtgggtacggtcaagtatgtgaaccgtgacgtggcggacgacccgtccgtggtcaacggcgatccgtacggcgaaggctggctgctgaaggttgagcttgacgacgatgagccggagctgctgagcgccgacgaatacgcgaaggtcgtgcggtagttccttttgagctcccctctctgaggggagccaagaaaatgaggcgtatggcctatattggtgtctatgagaagcccacgcgaggattttgaggcggcaggcaagcgactgccttgggatgctgctgctcgcagtgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaagtcaagccgccgatcacccgattcatacgtcgtgccgtcacccgcgtgttcggcgtatggtcacgcatctccactcaggtggtgcgccaatgggactggtatccgcgagtggaaccctatgtgggttatggcaccggcgattactcgcgtctgatctgccgcacggtatacgcccccaggcacgcgcaatccggcgaactgatccgcggcatccgcggcatgcttgccatacccgcgccgcgcacccacgtgcaggccagcattgatgacatgccgctcaacaccgtgcagatcggcgtctccgaggtctatgacaaggtggaccgcacgcgcgatctcggcagcgaatacgccatctccgattccgccggatatctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacttgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacggggctcacctcgacccagccgactccggtaaccgatgtgccagtattcaccggcaccaccggctcgaacattctgaagaccatgctgccgtatctgaagacggtgttgcgataggcgcggcgtgatgaacactgaatgcgtcccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgagggacatgacttcttccggctcggcggcttggatctgagcaaggacggccgttggatgctgtacggcgtggatgttgcgggagacgaacgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcggcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgccgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcattgcgttgcatcgcaactttgtgtccctgagctaccgtgccgacggccagccgcacgtggcatacatgaccaagagcgcggctgccgccgacttcctggccggacggccgtggcggtttacggaattgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcaccgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggtctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtatatgaagtcgtacacgccatacgagaatgtgccggtcgccgtgctcgagggcggcaacgacgaggctgccggtgacggcagtgctgatggggctgccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgctatctgcgcgatggtgcgatcctgcccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaacaccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacattgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgagcatctcggctttgatgatgcggccaagaagatccataccgccgtcgaagcggacatcgaggagctcggctccaccgtgcgctccaccgaccaggtcggcaaggacattctggcccgcatgtgacctcaaacctggctcccctcgctgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagtggtgatttctttattgaatcagtttcggatgccgaatctcatgctttgttgcatgacctggaacgagctctaattagcgatgattcattgcggtccgtattggacgctcaccctagttgccaaattatcggcacagatgaagttgccatcaaaaccgcatacagccgagccgtaagcagcaacttgcccccgctggcgggggctccagcgcagcgggtgggggtgggcagccccgatgcgccgaacatcccagcatccatcaatacacaaaccaagcagcccgacaaaagctctgaataccgggagcgctggaacgccctcaagcctcaactcaccgtgatccacgaccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggtggcggagcgatgtttatcgaaccgggcaacaccattacctattctctgtatgcgccgctcgatttcgttcagggcgtaagcatcgaagaatcctaccggctctgtgactggtggctggtcgaagcgctgcgcgaacttggcttggatgtgcggttcgcgggcctcaatgatatcgcctcgcagtacggcaagatcgggggagcggcgcagcggcgcttccccgtaggctcaggcggcgcggtgctgcaccatgtgaccatggcatatgacatcgatgcgtccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccggtggccgtgcgcggttttgtcatgggcgagcgcggtaaccgcgacagtgccgtttttcgcggtaacgcattcgtcagcatgccgtacggctatcggatcgtgccacacatgaagtgacgaatgagggcatgctcctgacgaaacctgtgggggcgcgttacaatatgacggatgggcgacgacggtcataggacaataaggatggtgcgatgagcttggaaacgccaaacgcttttgctgacgaggaaaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtccgcggtgtccatgagccatggcacgcgcgtggtctggctggagcatgatgccctgttcgcatggcttgatgagcatccgcgtgtggccatcgacatgttgcaggtcatggccaaccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagccaggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggtggcgtggcggccagcgtgttgtttgtaccgggtgtggtcggtgccaataaagccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgatgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtatgatccgctggtcgaagagaaccagaaggaaagcgaaaaccaacgcaatatcgtgctcaagctgatgctgcaggaaggatacatcacccagaagcagtacaccgaagctgtgaacacgccgttgaaggacacgctgaaagcacaggacgtgaatgtcggctgtcaggacactggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgagctttggcctgaatcgttactatgacgccactccggcagccgcgaacgatcccaccaggacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccggaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtggatcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtagcatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaattcgacgcacggtccaagaagcgggccggcgcgggcaagacgagcgaatcgttcgatgattatgaggattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgtgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagaacgtgccggaggaggcgggcggctggcctaccatggcaccgtctgaaatcgcgttcggtgggttgcgtacgccgcgcgcgctgtccgtggatgagattcatggtctggtcggcgcgttcgccgcggcggcgggccgtgcggtggccgccggcttccaggcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgtccctgagggcgtgccggttctggtgcgcatttcggccacggattgggccgccggcggttgggatttggaccagaccatcgcactatccaaggtgctgaaggagcatggcgtcgatgtgatggacgtgtccaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgtgatccatactggccgttgcgtgcagccaacaagctgggcataccgtccaccgagatcccctacgccccgcaatacgtggccggtgcgtactaaatcctcatggggcggtaactttcccatggggcggtaaaaccctcatggggcggtaacccaaaacggcggtattctgcggaatgtgaaatttggctaaccgccccatgggacaatcaccgccccatgagggttttaccgccccatgggtaatagggcaatatgtgagttcactccacgtctacgccgacggcgtcggagacgtgctcgaatccgtcgcggcgcagcagctgggccagaccgcgcttcaacacggtgatctgttgcgggcctcggtacatcagcgagctgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgctcggccagcacatcgagcagttccttgtactcgccccacggcttgttcaacggcatcttgaccaacgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcattgaaatgcagtaatcctcaatgccttcgtccaaatcgccgcactggtcgtcgttggtgcgggcgatcgacacggacagctgcatctggcgggcctgagtccaagccttctcggcacgctcgatgaccttgtccgaaccgatgttggcgaggccgacgtgcaccatcatcgaatcgtattcaggcagacggtggaaccacggcttggcgttgcccgggcaggggcgcgaggtggtggagcctacggtttcgaagccgaagccggcgtggtccagcaccacgggcatctcgcagttcttgtcgaggccggcggacaggccgaacgggttggtgaaatcgacgcccatcacattcgtttccagaatggggtcggtgtagtcgagcatcagctgttcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgttgtgccagaagctttcagaaacgtaagtcataccgcctattgtctcacgcttgggccggtgcggctaggtgattcctacctaggcgaattggggaagggggctaccgctgtgagaatatcgattcgcgcaatgtgcgattttgcgcggttttgtggaaatgacacctgaattgcccggaattttcgagaaattgtccccaaaacgctcaagccggtttggtttgtgagcttttgtgtgcgataatgttcgcatgatttcgtcacaacgtcagcacctcatcttgagcaggttgcgcacacgcggggcagtgcgcattacggcgctatcgaaggaactgggtgtgtcggcgatgaccatccgccgcgatatcgccgaacttgccgacaagggactgttgaagcgcgtccatggcggcgcggtgactaccagtaccttgctcagcgaacccctgttctccgtcaagtctcagatggatatcggcctgaaggacgccatcgcccaggaagccatcaaatatgtggctcccggcgatgtaatcgccatcggcggcggcaccacggcctatgtcttcgcccagcatctgctcgaatcgcagcagtccagcggcatcaccatcctcaccaattcgattcccgtggccgaactggtccaggccctcgaatccaaggacgtggaggtgatcgtcaccggcggcgtgatcacccgatcgaactcgcttgtcggtccgatcgcggacaaggtcgtcgcctcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacatcgctgtcgctgtttgcgcgcttcgaccaggtgaacacggtcattactgacgacgggctcgaccccgactccgccgccaaaaccaaggatttggtaaaggaactcgtgctggcccaccagagcgagaccattgaggaaagtgagtaaacccatggctgatttcgccaactacacccccggggagtatgcgaaggagcacatccgcatcacgccgacgacgcttgccgacggtcgtgacttcttctacctggacgacgaccccgagttcgtctccggtgccaagacccgcgagctcaaggacccgcgcccgctggactaccgtttcgccccgcacctggacgccgacggcaacgaagtgccgtacgccgccccgcagatgcgccgcgacccgctgaccggcgactggattccgatggccaccgcccgtatgaaccgtccgatcaccgccggccccggcgccaccgccaagggcaacccgctggccgcccgcaagcccggtgacccgtaccaggacggcgaagtgccggacaccgactacaacgtcgtggtgttcgagaaccgcttcccctcgatggtgcgcgtgcccggcgtctccgaggacgtgacctacgttgacggcaacccgctgtgggagaagaagctcgccgccggccgctgcgaagtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggtcaggaaatcggcgtctccctcgctcacccgcacggccaggtctactgctacccgttcatcgccccgaagatggagaaggaactccagcacaccgaggcctaccacgagaagaccggtggcaacctcttgaaggacatcatgaacgccgagctcgaagccggcgaacgcatcgtgatgcgcaaccacagctgggtcgcctacgtgccggccgccgcccgttggcccctcgaggtccacgtggctccggtgcgcgacgtgctcaccctcgaccagctcaacgacgaagagcgctgggacctcgcctccatgtactcgcacctcctgaagcgcggcaacgccttcttcgacaagggcgacggcaagggcatggacctgccatacatcgccgcctggcaccaggccccgatccacgacgcccgccgcgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtctcgcaagctaccaagctgttcgtcgacacctacggcgctgcgcccgagggcgtgtgggctgctccgggccgtgtgaacctgatcggtgagcacaccgattacaacgccggcctgtgcctgccgatcgcactgccgcaccgcactttcatcgccctgaagccgcgcgaagacaccaaggttcgcgtcgtctccgacgtggctcccgacaaggtcgccgaagctgatctcgatggcctcaaggcccgtggcgtggacggctggtccgcctacccgaccggtgtggcctgggcgctgcgtcaggctggtttcgacaaggtcaagggctttgacgccgccttcgtctcctgcgtgccgctgggctccggcctgagctcctccgccgccatgacctgctccaccgctctggctctggacgacgtgtacggccttggctacggcgattccgacgccggccgtgtgaccctcatcaacgccgccatcaagtccgagaacgagatggccggtgcctccaccggcggtcttgaccagaacgcttccatgcgttgcaccgccggccacgcgctgctgcttgactgccgcccggagctgaccccgctggagaacgtctcccagcaggagttcgacctcgacaagtacaacctcgagctgcttgtggtcgatacccaggctccgcaccagctcaacgatggccagtacgctcagcgtcgcgccacctgcgaggaagccgccaagattctcggtgtggccaacctgcgcgttaccgccgacggcatctccaaggccgatgaccagttccaggccctcaaggaaacgcttgacgccctgcctgatgagaccatgaagaagcgcgtgcgccacgtcgtcaccgaaatcgagcgcgtgcgttccttcgtgcgtgccttcgctcagggcgacatcaaggccgcgggccgtctgttcaacgcttcccacgattcgctggccgccgactacgaggtcactgtgcccgagctggacatcgccgtggacgtggcccgcaagaacggtgcctacggtgcgcgtatgaccggcggcggcttcggcggctccatcatcgcgttggtggacaagggccgttctcaggaagtcgcccagaagattgccgacgagttcgaaaagcagggcttccacgctccgcgcgccctcgcggcttatgccgctccgagcgcttcgcgtgaggcctgagcccgcatctgagctccctctgacgagggagcttcgttttatcccgcgacacgcggggcggacttacgaagaatcttgaatcgtattacggtgacggattgttttgaaaatcgcatggcgtctgccgaaatcacatggcagacaccatgcgttttttattgccgtcgttggcccggacgttaggggcgtaacgacattttcgcgcgacggcaatctgaagagacaatccgagagaggttccgttgtccgctatccagacaacttccgataacatcatgcccgccggcgaatccggcaccgcttattcccatagcccccacaacgcttccgaaaccaggcatttcgaccatccgcataaggtgatgctcggcctgtacatcggcgcatttctcggcatgctgtccgagacatccatgaacatcgccctgcctgatctgatggacgagttctccgtatcctccggtaccgcacaatggatggtcgtcggctatatgctggccattggcgtggtgctgccgtgcgtgggtttcatgctcaaatggatcaaagccaaaacgctcgtgctgttcgcgctgacctgcttcctcgtcggtgccttggtatgcaccgtggccaccggtttccccgtgctgctcgccggccgaatcgtgcagggcatcagcaccggcatcgtgctgcccaccatgtacgcggccatcatgcgcgtcttcccgccccacaaaatcggtgccgccaacggcgtggccggcctggtgatcatgttcgcgccggtcatcggccccaccctggccggcgcgctgatcggtgccctgagctggcgcgcgatcttcgcgctgttcgccgtcgtcgccgtaatcgcactggcctgcacggccgcattcttcgtcaccccaatcgaacgcacgcgcccggccgtggacatgctttccatcgtcgcctccgcgctgggcttcggctgcctcgtggccggcgtgagcctgatcagcgacatgggtttctccgtggcggtagtcggtttgttggtgattggcgtagtcgttcttgccctctacgcctaccgtcagctgcacatcgccgacccactgcttgacctgcgcgcgcttggcattgcggcgttccgtacgccggccatcatggtcagctgctcgtttgcctgcactttggcgttcatgtatttggtgccgcaggaattgcagcgcggactgggcatgagctctacgctcgccggtctgctcatgctgcccggcggcatcgtcaacgcggtgtgcacgctgatggccggtcgcctgttcgaccgtcatggtgcgagggtgctcgtgtggatcggtgtggtgatggcagccatcggtggcgcgttgttctttgccatcggtgttgactcgggtgttgtgctgttcttggccgcacacatcatcgtgatggtgggcatcccgtttattcagcagtcggcgcagtccgctgcgctcaaatcgttgccgggccgcatggctgctgatggcagcaccattctcaacaccatgcagcaggtgtgcggcgccatcgccaccgctgtggccacctgcctgctgggcctgggccagaccggctatgcggccggtggcggtgccaatgccgcgcagggcttcgtggacggttcgcgctacggctatatgttcggcctcgtgcttgtggcaatcgtgctggtcttctcctttatgctcaagggcggcaaggaagaaccgaagctggtgccggtgcaggtcgacgacggtgcggttgagagtctggccgtgtgaacatggcacaacggactcgatgattcctgagagtccgcgaatccggaaatggaacagcatgaatggcgtgatgcaggtttgtgacttgtctgagctgttccattccggcggtattggtgcctggcaacggtcagacgacagacgatacatacgttatacgattaacggcgtgtcgcgatgtgggtgattccggtgttctgcgagaacggcagtatggagccgaagtttacgtttgcggcgctgggtggactggtcaatgtgagcgttaactattgagataaacgattaacgatttatagtgttgaccaccgtaaagaaacagtcacaaggcaagtggctgacggggtcgtacaggtgcgtcttacatcggtgcgaggaggaaacataaaggaagaaggagcctaatcatggcacgaagaagtgttcgcctgttggcatcaatcgttgcagttgcgactatggccacggcgcttgccgcctgcggcaacaagcaggccaccacagatgagaatggcaagccgattgtcaacattctggttcgtcgcaacgtgaccgaccatccgatgcaggacacccagtacaccaaggatctggaagccgcctgcgactgcaccatcaagtggcaggaagtctccgacaacgcgtggggccagcagaagagcgccaagatggccgccggtgaattcccggacattggcttgagcttgttcagcatggtggatgcggccaagtacagcacctatttcgaggatctgaagccgcatctggacaagatgccgaacgtcaaggagttcctcaaggcccagccgggcgccgcgaagtacgtgaccgacggaaccaaaatcgccatgctgccgtctgatcgtggcaagggttacggggtttccggcactcacatgttcatcaacaagacctggcttgacaagctcggcctcgagatgccaaccacttgggacgagcttgagaacgtgctcgaggcattcaagacccaggatccgaacgacaacggcaaggctgatgaggtaccgatgaatatccgcggcctcggcttcggcctgtggagccccctgacgctgatgaactccgaaggcgtggtaacctccttcatgggcggcagcgcttccgaacagggctactacgtggacaacggcaaggtcaagagctactacacctccgacgcgctcaaggacgtcgtctcctacctgcacggactcatggccaagggccttatcccgaaggatgtgctcacccgcgacgcctcgcaatacacttcgcagaccgtcagtgacggctagaccgcgctgaccggcgtctccttcggctggtccaactacgccgaatacggcgacaagcttggcgaccagtacgtcaccctgccgccgctgaagaaggacgcctccacgcccgactcccaggtcaagtgggattattcccaggacgcctgccgctgggcctactccggttccggcctgaccgtcaacccgaacgccgctaaccaggacgccatctacaaggtcatcgacgccatgtatggcgagaagctttccgtggccggtttcttcggttccatcccggatatcgtctccgatgatggcgatcaccagtacaccatcgacaagaagaaggcttacgccgagtatcccgacacccgtgccatcgccctgcaggaccgcttcggcggctggatccgcgacgacgtgaagatggtcaacgacaccaatgctgaccaggtcaccgcctccgaccaggccatccgcgaggcgcgcaaccgcgtcgacggcgtcaaggacgtcgtcccgatctacgtgcgcccggataccgaggactccaacaccttgcagaacaacaacaccgccatctccaactacgcgaacaaccagatcgcgaagtgggtccagaagggcggcatcgacaaggaatgggacgcctacgtgaagaaggtgtccgaaccgaccctcggcctcgacgccaacatcgagatttggcagaagtggtacgacaagtacaccaagtagccaagcaataccgcggggtccatcgcacggattcgttcctctcctgtgaatgccgtcggaccccgcacttttgttccctagcaatcatcctaaattggagaccaacatgagtgcacaaacatcgcaaggcgttgctgcacggaccgtggcgatggaagcggctcccgaccgcaagaaaccaggtctgctcgatcgtatcgccgaccatttacgtcgctactggcagttgtggattctttccgctccggcattgttcttcgtaggattgttctcctacgcgccgatgtggggcatccagctcgccttccgcgagttcgatccgaccaaaggcctgaccggcggcaaattcgtcggtttcaaatacttcctggaattcttccacaatccgctgtttggtgagattatgaccaacaccatccgcatttccctgtggacattggtcatgggcttcatcttcccgattatcctggccctgctgatcaaccagatcggttctaagaagatcaaaggtttcgtgcagacgattacctacatgccgcacttcatctccgtggtggtcatcgtctccatgctcaacatcttcctgactcctggcaccggaattctcggtcgcttcttcggcgacgaatcactgatgggttccaccagcgccatcaccgcggtctattggatttccgaagtctggcagcatgttggttggaactccatcatctacctagctgcgctcgccggcgtggacacatcactgtacgaggcggcgaagatcgacggtgcaggccgtttgcagctgattcgctacgtcgatattcctacgatcatgccgacatgcgcgattctgctcatcatgaacatgggctccgtgctcaacgtgggcttcgataagatctacctgatgcagaactcgctgaacatgccggccaccgaaggtcatcgtcacatacacctacaaaatcggtattatcaacggccagtactcgtactcgacggcaatcggtctgttcaacaccttggtcaacttcatcttcctgatcactgcgaatgcaatcgccaagcgcgtttccgatacgagcattttctagaagggttttatcatgtctgcaacaattgaggctgttacccagaacaagaacgacattccctggaacaagcacgtgcgtcagaagcagaagccgggtgactgggcggtgtcgggcatcatcaatgtgctgctgctcctgaccattgtggcggtgctctacccgctgtggttcgtggtcatcgcatcattttcaaatccgaacgccgtggccggcggtgaagtgctgctgctacccaaggatgtgaccttcgctggctatgctaaggtgttcgccaaccagcgcatctggcagggctatctcaacaccatcatctattcggtggtcggcaccgcggtcaacatggcagtgaccattccctgcgctttcgcgctatcccgtcgcgagttcaagccgcggcgcgtgattatgttcctgttcaccgtgaccatgttcatcgccggcggcttgattccgaactacctgctgtacaagagcctcggcatcaacaacaccatgtgggtgttcatcctgcctggtgcggtttccgtgtacaacgtgatcgtggcccgctccttcttcgagacctctatccccgaagagctcttcgacgcggcccagatcgacgggttgagctactttggctacttcttcaagattgtgctgccgttaagctccgcgattctggctgtaattggtctgtactactttgtcggccactggaacgacttcatgacgggccttatctacatcaccgacgacacgaagcagccattgcaggtggtgttgcagcagttgctgttggtggcgcagggtactggaaccaatgtcaacgcggctgcgcagcagcaggccgccgatcagatcaagttcggcatcatcatcgtctctaccctgcctctgcttgtgctctatccgttcttgcagaagtacttcaacaagggtgtgatgctcggcgcggtcaagggctgagtcaaacgcaatccgacaagagacagccaatccaaaggccagccgatagaaaggattcgccatgcttgcccgcttctctgtggcctacgagcggttctgccgtctgctagtcgcgattttcgtggtcaacgtggccatactcgcgcacactctgatgggagcagtcgtgctgggatttcttccctcgttcgcggctgcgcaggctacgttccgtgcgtggctgctttctgaggactgttcaatgcgggccaaggaagtttggaagacgttccacggcttctggaaaagcgaagtcaagcgcgcgaatcttttcggttggcctttggttattttctgggccgtggttatcgtcgactactacgtgatgaactggcatgctcgcggcgatttcgacatcatggtttccggcgtgctgctgctcatcatcgtagttttggcggtgttctcgtccttggtttgggtggtgcgcgcgaactatgaagagagtcccgtctggattgttcgtacaacactggcgatgattgtggcacgcccgttgtgcagccttctgcaggtcggactgctgattctcaccgtgcttgtatgggtgcaatggcctggaattctcatggtgttcggtttgtcgctgccgatgttctgcacagcttggattgtttattcattcggccgtctgcctggaatggacattcatgaccgcatggaacagagcacgggccgcgcccgaaaccagacatcgtgacatgttcgcagaaaaagggggtgataaaatgctgcagtcgtcagtaagtcaacgagtgaacaggtccaaacgattggtatctatcaaagacatagctaaggaagcgggtgtttccgtatgcactgtgtctttggttatgaacaacaaggatcacaatcgcgtcagcaaggcggttgcgcagagaatccgtacgactgccgagagcatggggtacaagcctaattccgtggcgcgcaccttacgcaccagcaaatccaatactctgggattcgtcaccgatgagatagccacgactccgtatgcgggtcaggtgctccaaggggcgcaggacgccgcgcgcaagcttggatacatcctgcttaccgcaaacaccaacaatgatgccgaacttgaagaccaagagatatccgccctacgtcggtacaacgtggacggcttcctgtacgccatgatgtatcaccgtaaagtggacattcctgaggtattggaaggcagtctgacagtagtggtggatggtgaggacgccgcagggaaggttccttcaatctaccctgatgacgagatggccgggcacgatgccaccaaccgtctgattcaagccggatgcagacgcatcgtttactacggttccacaaccactattatcgcgcagggggagcgtctggatggctatcggcgtgcgcttgcggaagctggcattgcattcgatgaggcgttggtcgtcaatgtattggagatgaccaacgctgctgctgaggcggcgcgggtattcgacgaaatcaagccggacggcatcttctgtttcaacgatgtgcgcgccaccttcatctatgaagctgcgcgagaacgcggagtgcgcatcggaaccgacgtgtcggtgattagcatcgacaatcagccgttcatcactgatgtgatcaaaccatctctgaccacgctggaattgccccattatgaaatgggcttcgaagcggttcggcagctggttgccatgcttgacggcgataaggccgtagcggatctcgaatccgatcatggcatggcggtacagagacaacgagatggcggcaaaacagcattgcgctgccgcatcatcgaacgcgattccatcgtgttgtgacgggtgttcccctttttttcatatttagttttccgattatcggttttttttttcaatgcgtagccacgtgatatctgatcatgtggcgctgtggaggagcttattatgcctgacaactattccgttgccatcgaaaccggcggctaccgtttgctggaattgttcgccgaaagatgcggcgatgacgctgccgtcaccattacagacggggacggccatcaaatcgccagccatgccatgccggtggccgagcgtcgccaccgtttcttgattccggtgccgacaagcgtgtgtctcacggtgagagcgcgccaactgaccgtgcggttcgcttacttgtccgagtgtgagaatcttcttgatgaaggcgtgcgtttcatcagcatgaatccatatgacaatgaatgggatacgcagccgacgctggagcagatctatgatcgtttcgctcgccctgcggcgcatttcgagccattcgctcgctggatgaatgatcctaacggcctgtgtcgtttccaaggacgctaccatttgttctaccaattcaatccgtacggttttggctgggacaatatgcactggggccatgcagtgagccgcgatctggtgcattggacgcatctgccaatcttcctcgaaccgcagccggagctgcatatcgacgaacgcatcgttggcggcgcgttctccggatccgcggtgacggtggatgcgtgtgacaatccctgcaagggtgatgatgcggccgctattcgcctgtatctaacccggcacctggagactcgcggagacgaatcgtctgttactgaataccagaccacctgcttgtgtgaggatggtgtgcatgtgagtgtcgaatctccagtcgcgttgcgcgttaacgatggttttggcttcgatttccgtgatccgaaggtggaaaccggcatgtccggcgaggcgatcaatccggaacgcgcttacatggtgaccgccacgaatctgccggtcgccgaattcgatactgatgctgtgccctccgcggcgcctggcatcagcgtacagggtacagacggctggtttacgtgcggtccgcaaggcatgcccggcaccgacaagcccaatatggatacggtgcctgccatggcgctcttctccgcgaagaaaccgctcaagcgcaacgtgacgtggcagtatgaaggaccggtgctcgccgacttcggccaccagctgtcacgtacctacgaatgtcctgacctgttccagctcgacggcaagacggtcgccatcggagctctgatgcactaccgtgacaagcaaggtcgtttccagcaggtgcgttggtatgttggtgatctcaaggacaccgccgatggcccacgtttgcaggtagggaacagcgattggtgcgatttcggtaccggctactacgcgacacaaagctttgctgccgacgacgggcgtcgtatcgtgttcggctggtataccgactttcccgcgatgcgtgtggaaaagccgtgcatcgctaacggcatgatgtcgctgccacgtgaactgcacgtgcgtgacggccgcttgaccagccgtcctgtcaaggaagcgtacgagcagctgctaggcgatcgtttggaagcgcatgcaggcgaaaacgggaccttctttattgtgccgaacaacgcgtattacacggacatgcatctggctgacgatgacgatttcacaatgctcatcgcgaccggtaccaatcccgccaatggtaattcgatggaattgcagctgcagcgtcgcgacggcgtgacccgactggtcacgaagggaacagtcgtggacgacatcgatttcgatagcggcatcgccgatgtgcgtcgcgtcgaaatcttcttcgaccgtaatgtggtggaagtcttccttaacaatggcgaagcggccggcagtatgctgttccaaggtgcggacggcgatggcgagttccgttttgttgctgacggcaaggtcgattgcgtggatgtgcgtgtgcttgacagcatctggcggtgacatacagctgctgcagcggcaggtggtaactggcagtcatctcagtatgtaaggcaaaatagacgaaaggcacgtgttttggcacgtgtcttccctatacttgagggcacgtccggcaattcgccaagaactggatattcacacctcacgtttagggagcgccatgaacaaggcaatcatcaccgtcgtcggccaggatactgttggcatcatcgcacgcgtctgcacatacctttccgaacatcaggtcaacgtgcttgacatttcccagaccatcatcgacggtttcttcaacatgatgatgatcgtggattattccaacgccggcaaggaattcggcgagattgtggacgatctcgacaagctcggcgaggagattggcgtgcgcatccgctgccagcgcgaggagatctttaccaagatgcaccgcatctgagccgggcctcaaaagaaaaggacttaaggaaataccatgctgaatatcatggaggtccacgagaccaatcagatgatcgagcaggaaaagctcgacgttcgcaccatcacgatgggtatttcgttgctcgactgcgcgacggattccgttgagcaaacctgcgacaatatctaccgtaaaatcaccacgtatgccaaagacctggtctccacaggccaagccatcgaaagcgattatggcatcccgattgtcaacaagcgcatcaccgtgactcctatttctctggtgggcgccagctgctgcaagacttcggaagattttgtgcaaatcgcgcacgcgttggataaggcagccaaggaagtcggcgtcgatctgatcggcggttattcggcattggtctccaaagccatgaccccggccgaagaactgttaatcaaatcattgccgcaggcgctttccgaaacggacatcgtctgctcgtcggtaaacgttggctccacgaaaaccggtatcgacatgaatgcggtggagttgctcggccatatcatcaaagacatcgccgagcgcaccgcagacaacgattcctacggttgcgtgaaattcgtggccttctgcaatgttccggacgacaatccattcatggcgggcggtttccacggcgttactgaaggcgatgccgtgatcaacgtgggcgtttccggtccgggtgtcgtctcccgcgcattggatgcggccaaaggcaaggatttcgagttcctgtgcgaaaccatcaagcgtacggcgttcaagatcactcgtgtcggtcagttggtggctcaggaggcttcccgccgcctcggcattccgttcggcatcatcgacctttccctcgctccgaccccggctgtaggcgactcggtgggcgaagtgctggagaagatcggtcttgagcaggttggcgctcctggcactaccgcggctttggccatgctgaacgatcaggtgaagaagggcggcatcatggcctccagctacgtgggtggcctgtctggtgcgtttatccccgtctccgaagacaagaacatgattgacgctgccgcctccggttgcctgaccctcgagaagcttgaggccatgacctgcgtatgctcggtgggtcttgacatgatcgccattccgggcgatacctctgcttccaccatctccggcctgatcgccgacgaagccgccatcggcatggtgaatcagaagaccacagccgtgcgcgtgatcccggttgccggcaagggcgtgggcgagatggcgaacttcggcggcctgatgggctacgcgcccatcatgccggtcaaccagaccagctgcgaggcctttgtgacccgtggcggtcgtattcccgctccgattcacagcttcaagaactgattcggtagggtctcaccgttcaaagaggtacatccggtaactcgcagatagctgtctgctgtagagaaagtgcctcatatatgaaaaccccgagcatgaacgttggaatatcaacgctcatgctcggggtttctttgtcgacgtactcacggcaaaaacgatagcgcgccgccatccttccgccgcgatgatattgtgcgcctgtgggacgtgtcctgcatcttggcatacccctgagtagagttatgcccagtgtgaaatgtgaaacgtcagcgaaagggagaagatgacggtagcggatttgttccgggccattaagcgccactggattcttgagattattctgtttgtagttaccgtgggtgccgtagctggcttcaccttcactgctacccccatgtattccgctcagattcaactgatgccaaaggctaccgccagtgcagatgcgagtacggcccaatcgtcgtcggcagcggctcagttggcgaattatattgaagtggttcagtctgatgccgtgcttcagccgactatcgacaatttgggtctgcacgagaccgtgccgcagctcaggaagctggttgttgccgagaacgttaccggtaccactttgttagatatcacggtcacttatccgaacgccaaagacaccacgctgattcttaacgaggtggccaagcaactcaacaagcaggtttccgccgatgcttcggacatgttgacgctgactactgtgcagaagcctgttgaacctacgttgccctcctcgcctaacatcatagcgaatatggcgatcggtgtggtcgcagctcttgtggtggctgtgttgggtgcattcctgcgggagcttgcagacaacaatattcatgcacagaccgacattaccaatgcggtcaatgcgccgattctcgcatctatcccgaagagcttcactgtcgccgggcatgttcctgcggtcatcgtcaagccgcgtggccatgcggctgaggaattccgcaggctttgcactaatctgtcgttcgtcgagaacggtaatgaggatcgccctgataatgatcattccaatgtgattatcgtgacctctgccgtgcctgacgagggtaagacctcggtttcggtcaatctcgcagccgtatatgcagagaagggtgagagcgtactgctcattgatgcggatgctcgtcacccctctgtggcgaaggcgttgggcttgaacaatgcagtgggcttggttaagttgcttgcgggtgatgtcgatgcacgtactgccgtgcaacggtattggaagcccgagatgcaggtgttgcctgttgaggaaacttctacttcgaatgtgattcttggttccaatgtcatgcgtgacatggtggaccaggccactcgtcattatgaccacgtaatcatcgacaccgcccctattcaggtttccaacgatgcatcggtgtttgctcgctccggtggtacggtgttgctcgttgtcagccagaatgttggacagaagaaggctctgcgcaatacagtgcgcgagctgaaagtcgcccacgtaaggattggcggtgtggcgttcaaccgcgttgcgcatgagcgtagccgtaagggcaactattactaactatgaagagtcggaagtcaagaatcgccgtgcgaaggcctcgacgggtgactcatcacagaattccgcttcccgtaatgcccgccgtgggcgtcgtacaacggccgatggtcgttgattatacgtggagaatcgagagaaccgactgcgcggagtgagaactccgtaaggtggacacgttctaggggaaggcagagatttgaggcaacgagtcgtctttattgtggagacagtaggcggaggcgtacgcacgcatgtactccagttgttgaagaatctcgatccggagcgctatgaattaacgctcatctacggagaacgatatgaccacgtgttcgagtcacagcgtgaagagctggcaaagcacgtcacgctgattcttgattccaatctggttcgttccgctggccttcgggcgagttggaaagcggtgaaatccctacgggctacattgcgccgcatcaagccggatattgtgcactgccatagttcgattgccgggcttgttggacgtgccgccgccaaactggagcatgtgccgaaaatcttttataccccgcatgcttatgcgtttgacgcgccggagttctctgcgaagaagagagcggtgtttggattggctgagcgcgtgatgagtcgttgggcaaccacacgtactttcaatgtgagtgatggcgaatatcgcagtgcgctcaggcatcacatcgataagccgagcaaattcgccgtgatttacaacggtgtccctgaattgcagttgcccactcgtgccgagtctagacaccgattgggattggatgatttggtacctcaggatgtgccgattgttggtgtagccgcatggcttgacgctcgcaaggatccgatgacattcgtgcgtatcgccgaacgtgtgcacgatgatggcagaaatgcgcatttcgtatatataggctcaggagaactgcaagatcaggtgcgtgattttgttgcttctcatcatctcgaaggaatcgtgcacctgcttggctaccgacaggataccagcctattggtacgtgcattcaatgtgtacttactgccctctctgtatgaaggcatgccatactcgttgttggaatcgttgtgtgctggtgtgccgattgtggctacccgcactacgggcaatgacgaggttgttttgcctggtgtcaacggtgaattgttcgctgtaggtgatgttgcacagggcgccgcggccgttgaaaagttgttggacgattccccgaccttcgaggcggtgaaggacacctaccgccagcgattcactgaaggggcaatgatccgtagaattaccgaagagtacgaacaatagtcgtaggcccaacgaatggggccataatgccggtcgaatcgtcagacatggccgtgggcaagtaatgaatgtaaggagcgcagcaagccatgatactcatcaaggtatggtaccggttcacagggctaatgctgaagtggttgtaccgtattgttttccacggtgatttcgtgtatggcaagcgcttccatatgcgccgtgcatttcagctgacaattgagaatggtggtcgcgtggttcttggcgatgacgtgttcttcaatgatttctgcgcattgcatgcgcgcaagagcatcactatcggtgacggtacgattttcggcgagaacgtgcgcatctacgatcataaccaccgatttgccgatccgacgacgccgatcaaagaccaaggatacagcgaggctgcggtctctatcgggaaacattgctggattggctccagtgtgacgattcttaaaggtgtaaccatcggcgataatgtagtggtaggcgctggctgcgtggttgtgaaggatattccggataacgtcattgtgcggcagaatacggaactggtaattgaggagattagacgatgagcgagccggtgcgcgtgctcgtgctggacacggtgatggaccgtggcggtgccgagaccatgacgatgaattatctgcggcgcatggaccgcagcaaggttcaatatgattttctcgtcaaccgtgactataaggccgcctatgaggacgagattgcggaacttggcggaaaagtgtaccgcatgtgtccgctatatccgcaatatttcgacaagtacaagcgtcagtttcgtgggtttcttaaggtacatcccgaatatcggattatccattccaatctggaggaacgcagctatttcgcgttgcgtatcgctaaggagatgggtgttccagtgcgcatcgcccatgcacacaatcgtccggtgggatttgatttgaagtctgtggttcgtgagtacttccgtttccgtctgcctccctatgccacacattatttcgcgtgtggtcaggaagctggtgattggctgtttggcgtgaagaatcgcagtaaggtgatccaggagcgcaatgctgtagatacagctctgtaccgctacgacccaacagtggctgaagaggtacgcgcggagttccagactcctgaagattgtttcgtcctcggtcacgtgggccgtttcttccctcagaaaaatcacatgcagcttgtggatatctttgctgcagtgcataagatgcgtccgaatagcaggctatggctcgtaggcggtggagaactggacgacagtctcaagaatcaagtcaaatccaaggtacatgagcttggtcttgatgagagtgtggtctttactggtgtgcgcaccgatgtgaaccgccttatgcaaggaatggatttattcatattgccttccttgttcgaaggttttcccatgaccatgattgaggcacaatccgccggattgccttgcatgatttccgataaagtgccgccgcaatgcgatgtaaccgggaatgtgcagatcatgactttggactccactcccgaagaatgggcaaagcatattctcgatcagagtgacaaatatgccgcgaagtctgatcgcgccgacggtgcgaaatcagtaaccaaggcgggatatgacatcgtgaagaacgccgaatggctgcaggatttttatgtgaatgcattagccaaggctgaagcgagggaacgccgctgatggaacaaatagagacggaccaagtcgttcataattggcgtgacaaccataataaaaacgccgctataatgctgacattcatcgttatgatgattgcgaaaatcattacgctgatgttgccgaagaaatatttttttgacaataaccgtattctcggtatggccaacggcgatgattcggtcaaggcatggggcggctcatatgaggtggctgcgaatttcttcaagaccgttaacgtgttcaattttgtcaagatgactgattggagctggttcctcggtctgttgatgacgggtatcattctgttggtaatcaccagaattgacgagccggatctgcctcaattagtgttccttcttgcttgcgttggattgctgaatatttatgtgttcaatatcggcaaggacgtcattcaattcctgttcttctttgccgtatatctggtgattatctcgcctatcggcaacaccacggtgaagctattgatttcatcgttgattctgtattttgaaagtacggtgttccgtgcctactatattctgattgcggcgctggccattgcggtctattgcattctgcgcctgttccaccggtttgttaatcttcctcgtgtggttcgattactgggaattctgctcagtatgtatgtgctggtatgcgcggtgatgtttgtcgcacgtgtggccaagccagatgaattccaattgattatgagtgttcgcgatgccagccttgctggtcgtgatgcggataccgaggcctcggtcaccatcattcagaattggattggcggtgatagcgcatcgagcggcaatcttccgctattcctcgtgaattacggtatcaacgcggcccgtatgctcgttcccgtggaattactgacgaagggcatgcagtatattccattcttgcttttccagctggcggttacggtatatttggccagtttgtttgttcatgtcgatgagatcgaggatgaaaaccagttcctcgcattgtccattttcttgggttatttcctcgcgtcagctattttcgaacccgatttcggctcgtgggtgcggcacgaatcagcgactttcccggtgctccatttactggtgatgtcttccaaccaatgtgtttcagcatggaaggccaatgcggcggcccttaaatccaagttccataagcaatccaaacactcatcgtcatgggaaggtgaagtcgcgtgacgaggtcgcatatcgcgtttttctctggtgacattactcgatccgggggcacggagaacgtttccattatggtggcaaatgagttggtgaaggattcctcctataaggtttttttcatcagtttgttcgaggagcagccacaaccgtttttcccgattgacgaggccatcaaacgggacactgtgtattcgacagtcacacacggtattcagcattactttgatacggtaaaacagctgcgcggactggtaaaaaagcatcatattgacgtgctgattgatatcgacggcattctcgacatgtatacgttgccattgaaacgtggcacgggtgtgaaggtcatctcttgggagcatttcaactatctgcagaatcccggtgtgccctaccgtaaactaacgcggccgtgggcggcccgtaaggccgatgccatagtgacgctcaccacagcggacaagaacctatatgagcagcatctcaaccccaaatgtccggtcatcgacattccgaacccaatgatcgtaccgagtccggcaccggtatatgctgctgcgtctcagacgattttgagttccggtcgtctgacctatcaaaaagggttcgacatgctcgtggatgtagcggagcaggtgcttccgcggcacccggattggcagtggcttattctcggtgaaggcgaagaccgtccaatgctcgaagagaagatagctcgagcaggcatcggtaagcaactcatactgaaaggtcgagtaccggatacggacagctactaccgtaaatccgcgtttttcgtgctgacctcacggtttgaaggcttgccgatggtattgctggaagccaaggcgtatggtcttcccattgtgagttttgactgcccgaccggaccgtcagagattattgaagatgcactcaacggtaatttagtgcgtccagatgatatttctggcatggctgaaagcgtcaatcgcctcattgaagacagggcaatacgcgagcggtatgctctgcatgccggtgacggcgatggtcgctttgccaaggaaaccatcatcgaccagtggaagacgttgctgaacatggtgcttcgcccgatatcaaggtagtgatacgaatgaacgacaatctacagcattctgcgggtgcccggcgcatctcttgggtggactatggtaagggattggccatattactggtgttctgggggcatgccatatgcccggaaccagtgagggcttcgttctatgccttccatatcccagtgttctatttcctttctggttatgtgttttccactaggaaatatcattcgttcggaccattcctctggcataaggtccgcacgctcattatccccggcttgacgttcggtttcctcatagtcttcttcaaatggctgaacggcttgatcgcaggcgaagcgtattccgtgaacccgttgaagctgttgattggtgttttcgtggaattgcgtggcggcgattactcggtgattccatggttcttcgtcagcatattcatcatcgagcttatggcctattggattttcggtctggcaaaggaacatgctggtgtgcttttgtctctggctttgattgcctccgtggtcggctactgttatgccacgttcattggcaaaatcgtgccgtggagtttggaaaccgcatgtacgggcttcggattctttgtgcttgggtacctcgctaagtccccgggtaaaacttggtttgcctcgatcacccgaccggcatggttgccgctatggttggtagtaacggctgcaggcacgtggttgaatgtaactattgcccatcagcgtctcgacgtgtatatgaacgagtatggatggtatccgttcaccatgatgggcgcgttgggcggcatcgcgttggtgttggggttgttgcagttgctggaataccacgagcggaccgctgccgccaagccagtgagttcactgttgcgatacataggcaaaaattcgttcatcttctacagtctgaaccaagtgggattgcttatcggagaagagatcctgggagcctgcggtattcctctcaataacatcacatggccatggcaattgctttggggaggggcttgtataatgattgctgtattgctatgcgttccgatggtcgaattcaccaaccggtgcttcccccaaatcctggggaagccgcgtcgtattagcgctgcatcttgaaaggacacttgacatgcccacgcgttcggtagctctgattacatatcacgctgcgcacaataatggttcgttcttgcaggcgtatgccacacagcgcaagattcaacagcttggctatgactgcgatatcatcaatttctcgacgccccggcagcaatatctgtatgacgtatacaagaaggtgtctggtccgaaggacatcgccaagaatctgtatgcgctgttccaccacaagctgattcaacgacgtcacaacgatttcactaaccttatgcactcggcgctgcaactcactccgaagttttatgaggacctctcccagatgggtgatcttgagacacaatacgatgtattcgtctccggcagcgatcagatctggaacatggacgcgtgggattatagtgacgcttacttcctaagctttgttcatcacaagcctaaggtttcttacgcctccagcatgggcggtcatattcttgacaaacgtggagatacggcacttgctaaccattatcgaacactactggctgattaccaggccatttccgtgcgagagaagactgcgcaggattatctccagccgctgttggacaagccggtgacgcaggttattgaccccacattgttgcttgagcggaaagattacgaggaaatcacggctcctcggctagtcgaggaaccgtatatcttctactacgcgattgactccatagaacttaacgacagcgcggctaaggctgtgcaacagtatgctcaggccacagggttgccggtgtatgtaatgttcaccggcaataagtcgtatggtcttgagaagtatggattccatctgctggaggtggcggcaccgaaccattacctcagcctgattaagaacgctgagcacgtgttgaccgcctcgttccatggcacggcattctccattctgttcggcaaacagttccatgtggtacgtggcaagcacaacggtaaggtcaatatggatgaccgtatgagctcattgctctccacatgtggtttggagcggcagcagcttatcgagggcgaggcttggaccgatgacgttatcgattatgagtgtgtgtatccgctattggatgtggaacgcaaccgttcgctggattatctgcaatcggcgttgcaggtgaacgagtaaaaggagcacatcatgaaggctttgatgaaacgtctcctgcctgaatcggcattggcatggttacgcggatgcgaatccgatatgaaattacgacgtgaaacccttcaccagatgaagcggttccgccgcaactacgcaagacgaggctccacgcgcaaaagtcatctggaaactaggatcgtattctttacccatcagattgaaaaggggctgagtcacactgatttccgatatggtttcggcaaaaaggtgttggctcagatggcgccgctgatggagacgctgcgtaccacagacccggacatcgcacataacgaggtctatcgaaccgctctatccgcattgcacgaatatcgtgtgcggcatgaggccaagcaattcgatttgacttatgccaaagatctgttcagccaacggatatggaacgagattgaatccacgaacgaccgaagcggcggagaccttatcatccggagtacagacaagcgtgataacgcagagctttcgttctcccaacttatggaacagcgccattcggtacgtgaattcgctgaaaccccggtgacggtggaagaaatcatgaatgcggtgcgtgtcgccatgcgtacgccgtcggtctgcaatcgtcagcccacacgagtgcacatcatcactgatgcagagctcatcaaaaaggccatgccattgcagggcggattccgtgggtacccgatgccgcctgcgttggtgcttatcactggtgacaatcagacgatgatgaaccaggatgaacgcaacgaatgctatacggatggtggactgttcggtatgtcgctgttgcttgcactggaggaacagcagattgccgcgtgtccgcttaacaccatgttgccgatgaaacgtgatgaagcgacgcgtgaattgctccacatcccggacagcgaattcctcgttatgtacattgcggtcggccatttccgtgatgaggtgaagacctgtaagtctcagcgctttagcgctgatgagattgtgacggtacacgcatgagcgctgtaacaagcgaaaacagtaatgccggcttgccattggtcagtgttgtggttccggtatataaagttgaacgatggcttgatcgttgtgtgagcagcatcgtgcatcagacgtataagaatcttgagattattctcgttgatgatggctcgcctgatggaagctcgaagaaatgcgatgaatgggcagaccgagatagtcgagttgtcgtcttgcatcgtgccaatgagggggtctccgctgcacgtaatgccggtatggacgctgcccacggtgattatctgtgttttgtggattccgatgacgccgttgaacctcaattggctgaaaccgctgtgcgagccgcgcaacgttatgatgcgcagatagtcttctacgccaatatgaatgaccgctacaacgatgagggaacactgctggattccgcgcagcaaagttccgtggcgttcgttgcggagactgctaaagaattcaaacgtcattttttggaactgagccatggccaatatgtatgcccgccgtggaataagttgttcctgacctcgtttgtgaagcaggttggaatccgcttccccgaaggcgttgccggtggtgaggactccgcattcaacttccccttgtatgtggctgcggaacgggtggttgccattgatgagccgttgtatcgatactcgatgcgtgcgggcagcaccatgaacacatttgatccgcgtctgctggaaggacgcgtgagcgtccatgccgcactgttgcccatcattcaggaatggaatccgacatatctgaatgatcacgataatcgattgataacgaatgtgtggattgtgctctctctgctatatgccgatcgtagaccgcaaattcggcagaggagaggaacaatagtacgtggtatcattgccaatccggtggtacgcgaatgtgcgcgctcagtgaatgcggtcggtaccaaaaatcgattgatgaccgtgctcatccataacggcaatgtcttagctacgcgaatcatcatgcgtgcggttaacctgttgaagcggataagatcgaaggtgtcgcgatgacgggtgaaatgcaatcgccggatgcgttgattagcgtgatcgtgccggtctacaaggctgagcaaacactggatcgttgcgtaggcagtatcgtaagccaaacctaccgtaatctggaaatcattcttgttgatgatggttcgccggatgactgcccggccatgtgtgatacatggtcagtgaaagatgcccgcatcaaggtcgttcatcagaagaatggtggagtgacgaaagcacggaatacgggtttggcatgtgccactggtgatttgttggcatgggtcgatagtgacgattggattgatcagcactatttggatgagatgtatcaattgttggttgaatctaacgctgatatggcggtgtccaagaagcgggttgagtcgaatagcgcatgcgcccttgtatctgatgctgaagagattatgcagatgcatgtattgggacgttttggatttgagttatggcgcacgttgacaaaaacggaaaaatattcgaatctgcaatttcaggagctgaaagtcggagaagacgccgatatgctcatgcgagtgcgttccagatgttctcgaatcacggtatctcatattcaaggctaccattacagcataaacgagcaatcctcggtgcatggagttggaatagattccaagcttgattggatgcgcagccagcgtatgcaggaacagtatatcgcagcgcatcatccaaatcttttgggatgcgccaaatataatcgagtatatgcttttagccttatgctgcgaggtctgcgtggtgccgataagaataatgcgataaccgagttgaagaaaaaattgcgtcgaggaattattacggcattgcctgcattgccttggtcattgcttaatgcatccgaaaaacgtgaagcaatggctgccttaaaggtcgttgtacttgggtaattattaccgtaaagagattgatcgattatgaataagtatagaactctgttattgaatataggcttgttcggcattaatacagtcgcgactaaacttattactttcttgcttgtccctctgtatacgtactacttgtcgaccaaagagtttggcatcaccgacatgtctttgacggtgatttctttggtcctgcctattgcgtcaatgtcgatatccgatgcggtgttgcgttttgtgatagatgacagcaatgatcagaaatcagtggtgtcatatggcctgattgttatcggcttgagttgtgccattgtcgcgttgttgcttcctgtactgaaactctctgtattcggcgggctgggcaattactctgggtactttctgctaatgtatgtgtctacggcattgatgacctatgcgggtaatgtagcacgcggattgaaccagattaaaatcataccgatatgcgcatcgatctcaacactcatcacaggtatcagcgcatatcttttaatcgtgcgacagggaatcggcattcagggatatttcatatctgttagtgccggtccgttggtcggtactgcaatttataccattgtcggtaagcactataagtattattctcttcgttcgctttccggtaatgtgccgttgattaagaatatgttggtatatgcattaccattggttcccaatacgcttttctggtggcttggaacaagtatcaatcgcttcttcattactggaatgctggggattggtgcatcaggactttatgcagcagccagtaagattccgaatctgttgaatctggcatattccatttttcagcaggcatggcagctctcaacattccaggaatatcgtaagagcgacatcgggaaattcttctcgatgatattgattccgttgcaagcagttttgacggtcggtgcatctttcatcatgctgatttcgcagttgctggcttcatttatgctgcaaaagagtttctattccgcgtggacgttgattccggttgtcttgctcggcttctatttcagctgtatgaatacgttctacggaacggtttataccacactgatgaaaacgaaatacctcatgacaaccacgatagttggctcactggtatgcgtcatcgcaacagcagggttgattcctgttctgggactctatggcgcaggagcagccagcatattatgcaacgcggtgatttatgtaatgcgcatgataaattcaagacgccttgtgtcaatcgatgtgaactattgcatattggttatttccattgtgctgttaggcgtgcagatgatgattactgcgatggcggttccatattattgggtttatggcgtattgatatttctcgtattgactggcatgcacggtatgcgttgtgtgcctttgcttcggcttgttgtaggcaagagaaacaggtagggagaatgtcatgcagagcacaactatgaattctgtattccttgaatgctatcttgcgcacaatttaggtgacgatttattcttggaaactctcctcaggcgttaccctgatgtgcatttcacatgcgtggtggatggttcctatgattggctccttgaaaggtaccataatattagtctcgtaaggcctccgcgcaagaagagtgcattggggggggcgtccccgttcccggcgacaacaccccccggatcatcgacgacagggcaggaaagtcataccggaaccggcgacccggccccgaccatcggggctcggagaacaggccacgttcctccgtgtccttgcggtaatgcggtttcgtggccagctccaggcaccggtccggcagcccggcgttaaagttctccaggctccatacgctcggccggggcacgaacagcttgcgccgcaccatgccgaccttggactccaccgcgcccttctcatgaccggaatacgggttgcagaacgaacaatcgaacccgtaatgcgcctggaaggcctggaacaggtgcgtcaggcgcggctcgcgctccccgtaccccttatggcccacgccggcggcgttatcgaacacgatccgctccggcacaccgcccagccactcgaacaggttgcgcaacgccaggcacgtgcactcagcgttctcgcccggcatcaactgcaccagaccgacgttcgaatacgggaaatcaagcacgaaatgatgcatccgctgcaccacgccgcgcaacagcacgtcgacctcgccgaaatcggcctgcgcctcgcctggatgccataccagatccatgaacgcctcatcacgctccgccgcgaactcacgcctgagccgcgccaccgcccgcgtcaccgtggacagggagacctccgcgccatgctcgtccctcaaccgctcccagatcctggtcgcggtatgccgctgcttgcgccagttcgcgcgatcctccgcgagccactgctcgatcacgggcagatacgggtcgatcaccgacgcgcgcggctttctcaccgacggcacggccgacagatcctccttcgcgaggtacttacgcaccgtcggctcgctgacatgtgttttccgcgcgatcgacgcgacggattccccgttccgccgcaaacgacggatagactgtacttggggcatgctgatcataatcctttccggtcctttctggcggagatacaagcaccatccagttaagaccattccgtggtcggcatgctctgcctaaacccgaaaaatcatcgtgactaaacccgcaacaactaattgaacacaaacagagcacttccttggtaaggaagaggtcgtgagtccaattctcactcggggctctcaatcaccactcgatgccgtactcggcatacatatacatatcgtactggtactcactgctgtagttcaggtcgttctgatgtgcttcatgatggctgttatctgactgcataatcattccttttcctagcctcatcggtattacgaccagatatagcgaaatcgcgttaccgaactatgcgcgttcagcgaatcgcaggtgaactcatagcgaactgttgcacgcactccgcatgcgagcgcagactcattgacatataccgtccggcacacacttcataatgtgcaaggccgcgcgccagctattgaataccgccaaacagcaaaggaaagcctctcccaccatgacctcacaccttgccgaagcaggacgcacactgattccccgcaaggatgatcggtacggtctgctttccccagctctggttattctcacgtttgtcgccggactggtggatgcgttaagttacttggcactcggtcatgtatttgtggccaatgtgaccggcaacattgtgttccttggttttgcattcgtccacgcgcagggcttcgtctggtggacttcggcgctcacgctggccacgttcatgattggtgcgttcatcggcggacgcattattcattactttggcgccaaccgcgcgcgccatctgctggtgtccacgtcaatccagctggcttttgtggcagctgcgctcgtcggcatttatctgctcaatcagcttgcgcctgaaccgtcgatgggtggcactgatgcttcagccatcgcccgcacggcacagcccagtctgaacttcccaactgctcggcatattgatttgcatattattctgctgattgtgctgctcgcaccggctatgggcattcagaattccactgctcgtaagctttcggtgccagatttgcccacgactgtgttgacgatgacgttaactgggattatcgctgacacttcggcgcatggtcatgagcagtccaaacttggccggcgcgcgattgtaatgctggctttggcgctcggtgctttgactggagccacgctgcagacgcgcggtcatgaggacgttattttgatggtgatgatcgtctgtctgattgcggtcattgtgatgatgatcccccatgtgcattccgatgcccgctgggtgaccggaaaacactgattcatacaaaaacggccggcgctgggcattgctgaccggcaccggccgagataataaggagtgctccttatgtggtcgcgaaccttacggtttcatgatcacatctgctcgcgattgcggcggtaggcgattgcggcgccggcaccggccagcagcaatccggccacagcaatcgtgacgacattggcacccgtgttggagacgacattgccatcacccttggcagcggtacgcttcaccaagccggcaattgccttctcgagagcctcacgagctgcgtcgacctgcttctgcgtggcgttgctgttgtcggagacctcacgggccttcttcagcgcggcgcgcagagcgttggcggagtcgtcggtgtagagacccaggttgatggcggcggccttgttgatggtcgcgttcagagcagccttgtccaccacgcccggttccggattcggcttcggctcggtggcagcttccagcttggagatggcgtcctgaagagcgctcagtgcggtatccacatcctgctgggtggcgttcttgttgtcgagcacctgctgtgcagccttcagtgcctcggcgaaagcttcccacgagttggtcgtgtaatcggccttctcgagcttgcttgccttgttcactgcagtctgcaggtcggtcttgttcacctcaaccgggcctgggccaggctcctcaccggtcttctcgagaccagcgatagcggattcgaggttcgtcagcgccagagccacatcgtaagcggtggccttatcgttatccgccacggcctgtgcagcttcgcgggccttgaccagagcagtccagctttcagccgtgtagtcggattccttaagaccgttagccttggcgatggtgtcgttgaggtcggtcttgtccggagcgacagtctcttcctcaacctcgcggtccgtggtcaaacgcagttcggcagcggatgcgaacttgttggcctgggagtcgctctggcctgcggaagacaggacggtcaagcgtacggcggtcacattctcgacggcgtcgaagctggccttctgccacatggtggtggtggagaactcagcatcggtgacgacatccttggtggtgccatcctccagagtgagcgtgatcttgtagcccttgatcttgccgttggcgttcatacctccggagcgcggcaggtagcgcaggccgttgatggtggtcggttcgttgaggttgaactgataccatgcggtgccgttgccgactgcgttctcgctccagctggtgtgccagtgggtgctgtcgttgccatcctgtgccagatcggccgggccttcgctcggcaggcctgcggtaggctcttcgctgcccgtggccacggtgtagccacccagctcatcggagccgtcagctgccacgtcgtacttgtcgctgctctcgttgccgggagcggtcttcatgtactcgtcgagggccacgagaatgtcgtatgccttggtgaagtcctcagcggttgcgccattcttgttgatgagcacgcgagccttgaccaaggtgtcctgatactgctgccatgcggcatcggagagctcagcacgcttggaatcgtacttgccgcggatttccttgaccttgtcctgcgcttcggccttggtgcgggtctgggactcgatgcgctcgatcttcaggttgtcgagcacgaagtccttgtatccgccgaagtcctgtgcattgccggtggaaccctgcagatcaggtgcggttgcggtcgagtaaataccgaaccaggaatcgccgttgacgccaccggtcagctcgaactcggccttgccggtctcacccagagccttcttcaggttggtcagcttcacgctgccggcagagtattcaccctggcccacagcgatggcgtagatgtcatcggaaccggactggtagtcgaagctcaccttgtacttggcacccgcctcgaacttcacgttctgcgggatcgtctggtagaccagcgtgcccttctgggtcaggccgttaaccttcacagaccaagtgccatcgagcacatcgtccatcttcttgacatcccaaccggcctgcgtgaacggagcatgcagctcggagaggtggatgcggttgtcctcaacgccttcggaaccggagaccacgaacggccagatgccctgggcgttgttttcgaatccgttggtgagggacttcagcgtgccgtccttctcataggtgatgccggagtactggttctccacgatgcgcacatcgtcgaagtaggtgtgtgctccgtcggtgctcttgtgagacagggttaccgtggcatcgccgttctcaggcgcggtgaagaacacgtacatgttctggaagtagctggagccattttccgtatcgctgttcgtgttgtgaccgtatgccttgatgtagttcttggcgatggacttaccggtggagttggtggccagcaccttaccgccgctggttacggtgacggatgcgtcgccggtgctgcggttgtcaacgccaacatacagcgcgtacttctggccagccttgagatcggtcagacgctgggagacatcgaccttgccggtcaggcgcagcatggcgttgttatcgccttcgacttcagccttgccggagccgctgacggtccagttgtcggtgagggtgttggagccgccgttgaagccagcatccacaacgtgcatgccttcgctccagttgacctgaatctgcttggcctcgcccttgtacaccacgtacggggtttcggcatcagcggtaagcgtcaccttgccgccggagacggcaacggtctgctcgttggtcttgccctgatcggtgagctggtacacctttacgctggagaggttcttccagctgtccggcagggtccaagtggtggtgccacccttggtattccagtggtagagcttctgttcggaatccttgaccagcttgccggtggaggaatcccacagccacggcagcaggtaggactcgtcaccagtggaggaaccatcgcctgcggagacagcaccggaagccaccatcacgccgttgaaggtgatggtgcgctggcggtaggctgcgctagaggtgtcgttggaaccacgggagactactacaacgttgccgttggaatccttcagggtaatctgctcgttgccgttgttcgtgttcgggtcggacacggcagcggcattgccattgtcggcggtcagcagcgggttgttgacccagcgggtcaccttgaagtgctggatgaacttagtggacacatcatgggtgtacaggttcttgatgtaggcggcatagtcgttgcggccctgccagccttcgaagtccttcatgttgtagccgccgagcagcggggcgttggcagcgccgccgtattgcgggtagtcgccaacccagctgtccttctggtggttgcgcaggaagcgcatcacttcggagttctcgcccttggaggtgtagccgccgtaggtcagatcagctgcccagtgctggaaggtggagtcgtactcgttgccggaaccccattcggtggtcatacgccagccgttgtcgttgatcatcttgctcatcttgcgggtttcccaagaatcttccgaaccggaagaagtcaggttgccccacacatcgaggtagatgaagtccatgttgtcgccgacttccttgctgaggtcagcgaaacggcttacacgagaaccggatgccagatcgtagatgccgtcgatgccgacaccctgatcaagccagttccagccgtagctcaggccgcctgcagagttgcggcgcaccatgtcctcgctgaaggccttggcttccggatacatttcggaggcgttgacgtgcacaccgaagcgagcgccatacttggagccctcttccatcatggtgttcatgtcgtcggcgccgccgagacgctggccgatatcgccgtagtccgggtggccggagtcgtggccttcattgccgtagcccttgagcagcacggactggccgaggccgtcggtgttcaaggccaccttcttgacgttgtcaagcgtggtgaggaacgggttctgcgcctgggagccgaagttcatggcgatacgccatgccaccagttcgggaacttcctcggacttgtacgggttgttcatgatgtcgcggtaggcgattgcgccatcctgccagttgacggcaccgtcttcgttctcgtcgccggcgatggccacggccatctgcggcagagcggtttcggccacggtgtacttcttgcccttggaatcggtgaccgtgcggtggtagtaccacggagcgctggccaggcccagggaggtggcgtcaccagtctgctgggtggtggcgtagacacgcgtgttctggctgccgccgcgcacaggagccgccacataggtgccatcgtgctcggagttgctccacaggccggcactcaggccagcaccggagatgaagccgtaggtgtagtcgctatcggtgacgttagtatcttcggtcactgcgaagttggtatcgccaggcttctgcgtgttggaagacatacgagcaccagtgaattgggcattttcctggctggaacgcacggaaacgagactctggttcgggaaggacagcgtctggatggcgttctcctccacaccgttgccctcaggaatgccttcggacaggttgttcttgatcttggtgacgttgaggtgcagctggttggccttgaccgtgatctgaacggtgatcaccgcgtcaatcttcttggcctcatccttgaccttcagcgtgtaggtggcctcggtgtcggaaaccttcttgaaggtcacgtcgtcatcgcccagttcgatgttggtgccgttgatttcaacggtgcgcacatccttggactggccgtacatcaccttgccgtcggtcatcgtgtactgcagcacagaggggaagttcttcttaatctgaacttccatcttcttggtcttcagcgtttcggaggcgacctgaacggttttgttcagggtgatgggatcgatggcaagatccgcgccggagaccgtcacctgctgggagacgtcctcatagccttccttggcaatcgaaagcgtgtgttcgccttcttcaatgtcggcgaaggagaaggtgccatctgcaccggtcttcaccttggtcttatccaaacgcactgttgcgccttcaatggcagcgccttcagcgtccacaaccttgccggaaaccgcgtgcttggcggcttcgacaacctccgggaagtccttgatgtacacgtcggtgacctggttcagccccttccaggagccggccttgatggcaagcttgttggagaggttcgtcattgcggagtaatcgacatcgaatgccttctggccatccacggtcagtgtggcgacctcggcgtcggtccaggagacctgaatgtcgtgctcttcgttggcgctcggagcagcgatacgagcaccgctgtaccagctgccgctaccgccaccggtgtaggtctgccagaaccagccgtccgaatcgtagccgatgaacaggccgctgcccgggtcgttgtagcccaggtagaagccgaagcggttggcggagccttcctgcggggatttgatggtggcgtggaaggagccggccttggagaagtcgtaatctgtgccccatacggctactgccggccagttgttgctggagctggggttcgctgccgcattaccgttagaggcagtggacttgaggtgcagccaaccgtttgccatctccaggatttcgccgccctgagcgatgttggaatcaatagtccagccttcaaccgcatcggcttgtgcggaaggagtctcggaagcagttgcagaatcagaagtatcgttgatttgctgaatctgacttgccaaagtctgcaagtcagcatcagacaggggcactgcgaacgcagtacctcccccgctgcccatgcaggttaaggctaacgctgttgccagcgcagccgatatagtcttcttctttttcattaactatattttccttaatctcttcttcgaggtgaagcagatgccttcttcattgaagaatacgcattcgcaattacgataagacactttacaagaagctattcttaatagcaatctcagcaaatacggagaatcgccacatatttgacattgaattacaacgtgagtgaaatcacaaaacccaataaacgactacgttgttaaccttcacatctatattcgcatcatcgcgacacgcgcagggaaaaactgcgcaaaaaaagtaagacgaatttacctgcattcgacgcaatcaatgcagcagcattacagcagcaagccgattgagcaaaatagcaaaagccgccttgcgcaaccgcaagacggctttgacgacaatggtgaggctgtgctcgcttacttcttggaagcgttcacggcatccacagccttctgcagcgattgagtataagccttgtaccaatcagcctgctcgttgagcttcgcagtagcggacttgaagccggcagtgtcgtcagctacgcagccttcgtataccggcagttccacgctcagttccttgttgagggcgtccagcgtggaggcatcctttacatccttcttggtgagcgcagcagcttcggaagcatcgccattgaccaagttgttgtagtcattagtggcgttgcgcacattttcggaagcggcggcgcaagtggcgactgcattgttgtactgagcatcggagtaggcgcggaagccgaacacaccggccacgacgataatggccacgaccaccacggcgataatggcgacggccgccttagacatgtgcttcttctgagcgccttcattgcttgcattgttggcgttgtttgccggtacagcctgctgcccagcggacatacttcgatctccttcgttctcgtactttcatacacacgtatgcgctcttagcgctcttatgcgcactcatatgcagggaagtcgcttttcaagcggctacttccctgaaaacaaaaaaccctcgcattccgcgagggtcattggctgggatgcctggactcgaaccaagaatggctgaaccagaatcagctgtgttgccaattacaccacatcccaatttggcttggcgtagcaactccaaggagttgttcgtcgtacccccaaccggatttgaaccggtgttggcgccgtgagagggcgtagtcctagaccgctagacgatgggggcatattcagtttttcaaccggctgctcggtgaaccgcgcaacgagtgataaatatacgcaagtattcacccttacgcaacttacggcgtgtcgcgcggaatttcaacgatttcaagtgctacgctgccactactgatgaatttgcatgaactctactgacggattatcagtaagcactactgatgaattaccatctaatgcactgatgaaattgcagatgaggcaatgatctttgccttgcacattcatagccggcaaatcagccttcaagaaccaaatgaggcgcttatgttcccttgcgacagcgagcgcgtcgcgatgcttgtaatgcaatgtcacgtcaaagaccgccgcccggttacctatcaaccgtttcatggacgcatgaaggcgaaaccacctacaaggcacgtttcgtgacctcactgcacaaaccagccatgttcaacctcgtacatattctcactggcatgcggcgcagcggtaagactttccagctgttccagctcatcactgaatacaagaaaaggtgggcatctgcacatgcagacgcccaccttgagtgtccttacagctcagccgagcacggaaggaaccttagctcacaggtgctcgcgcaggcccttcaggcgagcgagggaaaccggcttgccgacgatctccatggactcgaacagcggcgggctcacgcgacgaccagacatggccacacgcaccggaccgaaagcgaggcgcggcttgtagccgccctcctcaaccagagccttgttcagggtctcatgcaggttgtcggtcttccagtcagcctcatccacagcctcgagtgcggcgatggccttgtccagcacctcgccggcagaatccttcagctgcttcttggcgtcgtcagccggctccaagtagccctcggtggagagcagggagccgaccatgccggcaacctcacccagcaggcgcacgcgcggctgaaccagcggagcggcggcggtcagcacctcacgctcacggtcggtcagggcatcccagttgtcggcggaaaccacaccgtcgcggtgcaggtacggcaccgagcggcgcaggaagtcctcgggctcaagcatacggatgtgctcggcgttgatggagatggccttgtcgatgtcgaagcgggccgggttggccttgacgtcgcgcacgtcgaacttctcggtcatctcgtccatggagaacacgtcgcggtccggtgcaatggaccagccgagcagggccaggtagttgagcaggccctcgcggatgaagccattgtcgcggtggttgaacaggttggactctgggtcgcgcttggagagcttcttgttgccctggcccatcacgtacggcatgtggccgaacagcggcatctccttggcgatgccgagttccataaggtaacggtaaagcacgatctggcgcggggtggagctcaggaggtcctcgccgcgcagcacgacgttgacttccatcatcgcgtcgtcgaccgggttggtcagcgtgtacagtgggtcgccgttcgggcgcacgatcacgtagtccggcacggagccggccttgaactcgatggtgccacgaatcagatcgtcaaaggcgatgtcttcatcaggcatcttgatacgtagcgcaggcttgcggccctcggcgcggaaggcggccttctgttcatcggtcaggttgcggtcgtagccatcgtagccgaactcggccggacggccggcggcaaggttgcgctccttgatttcctcaggagtggagaaggactcgtaggcgtagccggcttcgagcagcttggcggcaacatccttgtagatggcggtacgctcggactggcggtacgggccgtgagggccacccacatcgatgccctcgtcccagtcgatacccagccaacgcagggattcgaggatctggttgtagctttcttcggagtcgcgcacggcgtcggtgtcttcgatacggaagatcagcgtgccgccggtggcgcgagcttccgcccagttgaacagggcggtacgaatcatgccgacatgcggggttccggtcggcgacgggcagaagcgaacacgaacgttcttgggcagttcgggtttggtgttttcagcatcagtcatagtcccctattgtgccgcgcgcgccggacgcggagagcagcgctcctcgctcttttgcttcgttattgatgtttcgggccaacaccatcccaaaacggccattttccaacgaaatctcttttgcctgccatttgcttttcttttaaaagcaaaatcaaaagaaaagaaaacagcaaacgagaatcagcaggccaggcccacgaacagcagatcccagtcttgagattcgtcttcatgcgattcgcgctgctcaacggcggcatccgtgtattcgtggttcatggcattccctacatctctgtatgttgctttatgcatagcgccaaaagcttcgtctgctttccagttccacccccgcaactgtgcgcaatattcatgcaacaggttacacaaccgatcgataacgttcaccctcaactgatatcgatttgataaccatcgattctttccagtgcattcaccacaactttggacattatttggcgcaattgttgagttttccactcatgcaatggaagaatatgatgtgacacataggtcttatgaaaggggaatcaatgtctgatcccaacaatgtgcctttgcctcagcagcctgaggccaacggtacgcccacacctaatcccgtaccgcagtatggcgcaccggccccggcgcagccctcacagccggcgcagcccgcttacggacagccggcatacggccagtctgctccgaccgcgaactcttatggccaggccgtaccaacctacggtcagcccgcgcccgacgccaacacctacggtcaatccgcaccggcgtacggcacaccgacccccgatggcaatccttacggcccggttccgccgtcttacggccaatacgccgcgcccactgccactgtgccgctggataagccttactacggatgctccttccaagaagccttcctgcgcttctggaagaagtacacggtgttcaagggccgcgcgtcccgcagtgaattctggtggtgggtgctggccgctttcggcatcaatatcgtgctggacatcctcaacaccgccacagatgaaaagcttggcttcctcgccaccatttggggtctggcgaccctaatccccaccctggcactttccgtccgccgtctgcatgacacgaacaagcctggctggtgggttgccattttctatatcgcgatggttatcggccttatcatcatgattatcggcggtggtgcggcactgtacggcgggttcaggagccttggcagttatgactatggttatggcagcatggccgccggcggtcttggcgcggcggtcattggtgcgttgattacgctggccggctgcgttgtctatatcgtgttcatggctcttcccagcaagccggagggcgcacgttttgacgatggcgcggcggcaacccccatgcctcagggtgcttacggcgcaccatacagcacgcctgtacccccgaatttcgccgctccgaacgcgcccgcacccggcttcaaccagccggccccggcttacggccagccgcccatgccaacccccgactatggccagccggctgcacccgcacctgattacggtcaggtgccggccccgcagtacggccaaccggaggccccggccccacagtacggccaggttccgccgatgcctcaaaacgccggcgacgaatccgcaacaccttctgagcacacggctcccgccggcgacaatgcccagaaaccctggcaaggccagtaaccgatatcggtgaacttccgttgaagaagttccccgcaaccaatgatgaagccctactcaacgcgagtagggcttcatcattctcggcactgtattatcggcactgtattcagccaactaccccaacggcatcacggcaatggactgcgaaagcatatacgattcacccggactaagggcaacgatacggtctcggcacgccgctgcctccacggccacaaagccacgccattcacccgtcttggcatgggcaatggcgttgccgccctgctctccgggattccacaccaccgtctgcggcgagccggtcttgccgatgcgaatcacacgacccagcacatggtcctgcaattccagtgcagcatcggaataatacacacggtccaccggctgatcgccgaacatcaccgatggctgttcttgtagttttggcgggaatccggcttccgtggcatccagatatgttgcaccccgcaaaccgaccagccgcgcgccgagcacatcgccgacatgcagatacgagtgcagcgccgcctcatacgacatcggctcacctcccgtgttggtaacggtcagcgtcatcgtcagcgtatcgctggcacacacctcgtatgcggcatggaaacgcacgttgggttcatcctcgatccatggcacttcgccagtcgtcagtcgttcggaatccagcacataccgcacacgggcaccggtaaacgccccttcgtccagcgcccactggcgcaatcgtgcgaacccatgaatcggtcgcttcgcagtctgcccgccatgcacaaaccccggcccgaaccaggggaagcacaccggcactcccccgccaaccggctgaccagcttcgaaatgccatgtgcggggcgtccagattacatccggctgccccgccggggcccagcgcagcagatgcgccccgtaatcgctgattaccgcgctaccgccgtcattggtgagcgtgcgcagattgacgccattgcccataagtgtttcttcttccgttgcgtaagcgatgttcttcaccacatagacgatttccttggcacggaggaatcgcgagcaggggtaagagaaccgatcaggcgggctaagctgccttgattctcacaactccacggtttctttgccagggtcatctttaatgtgcgcaaacttggcggccaaggcctccttgttgcgcttttcgtcttcttccttggccttcttcttggcttcgtccgggttccagagcacatcgtcgcggtgcttggtccattcggcaccggccagcggggcaatgtattcggcggtggcggtcagggtgtcaccggcattggcacgcgtatcaatcagatcaagaatctgctggtcggtcaggcagatgcgcggaatcgagcactgctcacgtaattcgttgacgtacagcagaatcggcaacgttacgatggcggtggcccgggcctcgtcagcaacatcagcggcatcagcaacagccggaccaaccaagccaaccgtctcggcatgcccgctcaccacgttcagcagcgcatcgcatacggcgagcgcggtggcgaaacggacggccacatcagccggctcgccggaagccgccaaacgtccgccaacctcggcatcggcctcaacctgagcctccacggagacaaccgtctcacggactgcggcctcgacatgcgaatcccagtcaacacctaaagcttcggcggcatcgaaaatcagctgcacatcgccggattccgagtaaccggccatcgtatcgtaggcgtcattggcagcaagcagcgtgtctacgatgctttgcggacggccaggaatctcatcggccccctcgtagacgaattcggcgtcaggcatcgtaacatcctgaccggtgagaatgcgtgcgaacgcgtgcgtgacacgcacctgcaggttctccgcatacttggcgtcattgtccatctgcatggcttcggtcagcggccacaggctaattagcgccgagccggcttcagcggcctcagctacccccggcaatgccgcgatccgtgcgattgcctcacgattgagttcaatggtcattcatgctcctctgcgttcaccacttgattgtagtgcgtcccattggctccctctgaggggagcccagattgtagctcagctattcaccagtgtgccgttacttgacgttggctgctgggtcgacatacgtgattgacatcacacggccggtttcgttgtcgtacgtcaccgaggtcacggaggcgagcgccgtgtgccgcaggaacatccagtgctcggggtggccggtctccagataatggcgataactgaaaatcggcgattcgtggctgaccaccacaatctgttcgccggggtgttgggcgaccttctcgcgtgcgaaatcatccatgcgctgcgcaatgtgctgataggattcgccccaactcggcttgtacaggttggtgaccagtttccaattgccgttcttccacagcgcgccttcgccatggccgatacgcttgccgcggaactcgttgccggcctcaatcactcgctcatcggcggtgagcatgagcggggcttcgcctcgggcctcgcgcacgggattcaacgcgtcaagaatcgcgtcggcggtctcgcgcgtgcggtccaggggagacgaatacaccgcggaaatcatattggtctgagggctattggccagataggcggcggtggcctgtgccatacgccggccaagatcggagagatggaagtcgggcagccgctcatagagcagatggtcagggttgtagaccttgccgtggcgaacgaagtggatggtggttgcgctcatgagccgcctttctttttattcctacgggcatcttgcgatgttcgccgaagaacatgagaacgttgtcttaatatctccaatctaccgcgtgtcgcgccctaaccaacgattagagtatccgtgacgcaaatatgcgaatagggaaatccaacgcaaactttgcgcgaccatggacaacacatcattcgatgagggcttcgccggcaacgccacgtcagcggggaacatccaatcgggagcggaaaggagcgtagtgctgttatgtccaacaacctgtccaactcgaacaccattatggctggcatcaaggaagtgggtcacaaagtttttggtgggtatgcggagttgctgcgcatacctcataccgctcgttattccatcggttcggtgattgcctgcatgccgttcccgatggtgggcatgaccatcaccatttccgtgcagcattactacggcaactactcgctggcaggtatgctcaccgccattcaggcgattgcactggccgtggccacgccgctgctcggcaagctgaccgacaagttcggccagcggcaggtttcgattccaacgattctggtgtggattgtcgccgccgtcgcgctgaccacatccatcaccaatcgtgcgccggaatgggtgctgtactgtttgacgccgttcctggcagctattccgccgtggggcgcgatgagccgcgcgcgctggaccaaaatcctgaagggcgatcaggagcgtaccaaccgtgcgctctccctgtgcggcgtgctggacgaatgcatgtgggtaatcggcaatccactggcttccacactggccgtgatctccggtctgctggcattctcgttcaccggcatgtgcgtggtggtgggcgcgctgatgttcttgaccgagctgaccactgagccaccgtcacagactcagctggcccgcgctgagggcatttcccgcaaggaataccgtgagcgcgaggcggctcgagccgaagcgttgaaggtggagaccgcagccgaggagactcgccgccgtcttgagcgcgaaggcgtgaccgatgaggccacgattaacgccgccattgagcaggcggtcgccgatgcgcgttccggcaagaaggcgtccatctggggaccgggtctgattgcggtatgcgtcacctggttcggcttgggcgcgttccagtcggctacaggcatctcgatcatcgcattcgccaccgagtcgaatatgaagcagtacacgggctttgtattcgcctgcttctccatcagctcgttgatgggcgccttggtgtacggcgcgaagaactggtcgattgccctgtggaagcgcttctacttctgcctggccgtggtgaacatcggcatcagcacgttcctgttcgccaagcatctgtgggtgattatgatcatctacctgatcatcggcgtgtgccaggctccgacgtggattaacggcaaccagctcatgctgcacttggtgccgccttcccgcctgaccgaaggcatggcgtggatgggtgcgatgaattctatcggctcctccgccggttcggcgattgccggccagttcatcgaccgcatgggctcgcatggcggcttcatggtggtgaccactttggcactggtctcgctggtgattgcgctgattggcttcaagcagatcaagggctccaccgagcagccgaccttgactgaagtgagtgtgtgagacaaaagctaagccccctctgacgagggggcttatacgtcaaaacgctacttcggccagcctttgggcgtgtgttccagggaccagatgccgagcttgtgggagaagctgttctgccacttggcttcaagctcctcggcattcagtcgattttcagcggacttcagacggttcatcgcattggtgtgcgtatcgtcgagcagccacttgcgaatcaagaagttccagatcattaccacggcagtggccaccaacttgccgatattggtgcgcaacagatattcggcatgctgcgatacataggcatcatggttcatgccataagtggaaatccagataatcgcgtcattcatgaacagaccgactacagcgcccgccacgaagataagaatctccatccagcgcgccatgtcatcacgatgcttgaatacgaatttcatgctcgccagatagttgaaaatcagcgagatgatgaaagagacggtggcagccagcacgttgtgcatgtggaatatgccaaccaataggttgagaataccccagtcgataacaaaggcgatgacgcccacaatgccgaacttcatcagttgttcaatcagttttctcacaagggtattcaacactattgggctgactgcggaacatatattggctggaaaggccaataatctccccaaattggccttgccccggtccgttctgcaagcagcttcctacatccgcatgccatgttcaacagcaaccgctgaggctagactggaagcgaaccgaatcaaggaggaattatgcccgttattcacactcatgtgtccgtgcccaccacccctgagcagcgcgaggcgttgaaggctgcctatggcaaggcgattaccgccgtgccgggcaagtccgagggctggctaatgtgcccgttcgaggacaatatgccgatttacttcggtggtagcgatgaccagcccgccgcctatgtggaagtcaacgtgttcggccgctctgtgccgggctctgcttgggaaaagctgaccgagagcattatggccgcgctgaactccacgctcggtattcccgaggaccgcacctacatccgttacaccgccaccaccgactggggctggaatggtggcaacttctagttgccaccattcccctcgcagcatagctgctcgcatcgcctacggaaagcccggtgggctttccgtttaacggctcagggtagcaacttctagtttgcgtatgctggctcccctcagtcagcttcgctgacagctcccctcaaagagggaagctcagatgtagaaagcccgccggtggcgggctttctacgtttcaaggggctgatttccaacattcagaagctctactagcgtttcaaggggcttttaaaacaagaaaaccggagtataaacattgcaatttcaatggtcatactccggatttcgcaatcgaagagcccctcgaagcgcagatagacctccggaaaaccgaaaatccgcccctcaaaagcgagttacctcacctcatgcctgtcatcacacgatcttgggcatgggggtggtgaggctggtggtcaggttgacgtggaccagaccggcaccggcatgcacctcaaccttcttcagggtcacggtgcgctcttcttcgggggcacggtcgttgtcggtcatggtcgccggggacttgaccgccacgaacgccagatcgtccagcgagatgcctgcgctctggcacagttccatggcctcggacacggactcggtgaagcccggcttgtaaatcacgcgctcggccggtacgccgtaggcgttctcggccacccacttggcgttctcggtcagggccatgcccttgtgcgagtgcggttcggccggcatggagccgttctgcaacgcgtcgacgaaaccgtcaagctgcggggccagcgcctcgccgccgtcgcggaacaggttgccgatgatcggcgtgcggaagcccagctcgtcggcggtggccttcagggacggaacctgatcgtcctcgccttcccacaggttgatgagcgggaaggtcggaatgtccaggttctccaggcgctgcacgtggaacgggtagcgccaggccagctcgggatcgtcgcgccaggtggaggcacgggtcaccacgatggcggcggacggccactgcgcgccgtattcgcggcaggcgatgtccagccacttctgggcgccggcgtcggtgccgtaaccggcctcgacgatgaccacgtcatgcagggcgcaggccatttccacggagaccagcgtcggaatgccgatggacacgttggcgaacgggccaccgtgcacgtagaccggggagccgtttacggtctcggtcttggccggcttgaccgcgtcggccagaatgccagtgatacgccacaggtccacgaattcgccgaaggtcacggccttgccgtccttggtgccggcgatcatcttggacacgcgctcggaaatctcgtccatcgagcgggagagcaccacaatctgcatgagctcgcaggtcggcgtgagcacgaccttctccggcacgttgcccttgccgtagtccacagcggtggagcgcagggagcggctcggaacctcggagacacgcggcacgagaatcgtgtcgagcttgccgtcatcgatggccttctcggcgaaggagacgagcaggttctgggccgcctcgatggcgcccatttcgccgcacagaccccagtcgatgagctcggggtgggtcagggaagccttgccgccgccggaggcaccgcccttggaaccggctgcggtgatgcccatgctcggctgacgcagcacggcggtcgcatcaatgccgcgcttgttcagagcgtcgatcagggcgatggtcgtggtggtcttgccttctccgcgcgatgccttgagcggcgtatcggcggtgacgagcaccaccttgccgtgcttgcgcggggcgtcagggttctcggccaggtacttcatgtagccgaatgcgtcgatcttctggaccagaccgtactggctggtgaagtcttcgatggtggtcatataaagcctttctgtgtttgtgtgatggggcggggtggtggggcggcagtcgccgcctcttcgcctaaaaacagcccactgggctgttttcttaacggctcagcccctcagggaggggagctcaatacggactaaaagtcggacatgtggaagccgttcttcatttccatgctgcgagtgtacagcacggagtcaagcagcttttcggtttcctccttgagctggtcggccatggtctggttggcggcggcgagaatctcgcgcacctcggggttacgcagcgcggcgatggtctcgtccggggtcatcggctgcacatcgccatccacgttgtcggcctcaaattcctcttcagcggcggactgcgcggcttcctcggcggccgtcaagcccagacgggcgatctgctcgtcggtggcggcgaccaagcggtggcccatcgcaccggtcttctcctggtagcgctcaacggcgttggacgtggagcggaaggcgccatcgcacagggcggcgatgatgcggttggcccagtagaagttctcggacgtcacgcgggtggtggtgtcctcaaggtaggcgggcgtggtgtccacgttcgggaagaacggtaccagcgtgttgaacgggttggagccgtatgccatccactggatggcgcgggaggcctgcgggcggtacgggcggatctgcatcaccgcgagctggctctggcggttgatgccgatcgtgcggtacatgtggcgggtgcgctcatcgcccagctggccgtacggatcgaacggggtgccctggtagtgggagctcagcacgtacttgatatcctcgatggtcaccttgcgctcaggctgacgggcccacgggatgtcgtcggaggtgggcttgtggtcggcgtccgggccgtcccacacctcgtcgtacgggttgaggaagcgctgcatgtaccaggcgcgcggggtgttgtacacgtggtcggagtcggagtgggagccgaaggcatcgcgcgggttgaacggggtagtgttctccaccgcgaggtccaaatggttggtttcgatgaattcggcaaggtcttcggaacacatgtgcgcttcctggtcacccagagcgtcctcaaggtcgaattcgtcgataccgagctggttcggcatggtcacgtaggcctcgtccggcacgcgcttggcaatccagtgatggccgcccacagtttccagccaccagatttcgttggagtcggagaaggcgacgccgttcatctcgtaggtgccgaattcctcaagcagcgcgccgaggcgctggacgccctcgcgtgcggtcttgacatacggcagcacgatggtcaggaagtcctcttcgccgatgccgccgggcacctcgggctcatcgcccttggccggcgtgtattccacgaacgggtcggcgccgagcacgcgctcgttggtggtcagggtttcggtggcgctcatcgccacgttcgcctcgttgacgccggcctcgccccaaataccttccttgaggtccgcgttcggcacggcggtgtactgcagcgggtcgtccggcagggtgatggttaggtgggagatcaccgacttgtattcgcgcggctgttcctccggcttcacgacgatgaagcgcttcgggttgaactcgccgttcgcggaatcctcgttgcgggcgatgatggtcgagccgtcatagctcgcgtctttgcctaccagaatcgtggtgcaggccatagtgtgatggtgtcctttctttgttgtggtcacgctcccactggcgggagctggacgacgaagtcggactgaaggtggttttgtactgacccacccccagtcagtgatgctgacagcccccgcctgcgggggctcatgtggctcacgccttgccggtcaggaagatgccgtcggtgtcgggcacttcaccgctgttgcgcagcgcgtgcaacagctcgttgagccagaagccctgattcaagccgggcaacggcttcttggtggcccacacctgcaggtagtactcatgatccttgtccggcggctgcggaccgttgtaccgcatgatcaccgccgggtcagtgctgcggcccaagaacttggaggccgaggagttgcacccctgcacggtctcgggaatcatggccggcagctgacgggagaagtccggcgggatggccaacgcatgcgaatcattgaagtcgtacatcagcgcatcaatcggcagattggccacggaccagtgaatccactcgaagccgcagaccggaatcgaatccgggtccacgaactcccagtgcaggtagcgggcctcgggatccacatcatcgatgtagaacgggaaggagaccacaggcacgccaccattgaaatattcaggggccgcagccttggcgaaatcgtccgggatgacggtgaaatcggcggaaatcttcatacgtcccagtatcgctcatatgtgtgacgtactgggggctgtgcgttacggggtctctcccccagtctcgctgcgctcgacagcccccactcatcagaggggggctagttgcgtcgggttatgagatcagggcgcagaagagggactcgaataccagtagcgggttgccgttgccggctaggcgcttgcgggcgtgggccacttcgtccagacgggtcacggcaccggcccggttcaatcgcaccgacaattcggtgatcgacgagcggttctccaggttgatgaggcccaccgaatcctccgcattgttctgcagcaccgccacatctcggtagatggaagcgatggagttcagcgcacgatccaatacgtcgcgcgtacggcgggtgaccaaacgcttcacatcgtctttcttggcaatctggttgaatgcgccacgcagtttcggcgggatgcggtcgctcggtgccagtccgttgatgcggcggaattccgcttcctggccggcggtgatgcggttcgcgtccgcctcggcctgggccttggcattgtcgataagattgccggccaacaacactgcatccgaggcacgggccagattcagcacaccgaccacaagttcatcgcggtcggacataacccgttcgtcggtggcgtacaacttggcgatgccgatatggccttcggcgagtcgggccgcacgctgcgccacttttggctcgacattggtggtggaggtcaggaatccggccaccgcctgggtggagggcacggcgaggttcacgatgcgtgtgcgcgagcggatggtgggcagcacgtcctgggcgctgggcgcgcacagtagccagatgcaatgctcggccggctcctcaatctctttcaagagcacgttggtggtgcgctcaagcatgcgatccacgtcttcgatgatgatgatgcgccacggcgcggtggcgggcatctgctcggaggtagtgatgatctcacgcacctgatcgataccaatagtcaccttgttcgtggtcagcaccgtgacatccggatgcgtgccggcaagcacctgctgggtgacgcgcgtgggctcagcgctcatgccgtgatccgggctttccagcgccgccgcgaatgctcgggccatgttggaacggcccgatccgggaggtccacagatcagccacgactgggtgatctggctcgggtcgccctgcgcgatacgactgagcatgtcgattaccggcttttggccgactagtgaatcccatacgctcatgcgagctccttgatgtcggattcgatggcagcccataccgcttcaatgctctggttcgcatcgataacgcggaaacgattcggctcggcggcggccaagtccaagaaggcctggcgggtgcgggactggaagtcatcaccggccgattccatacggtcttccgcgtgttcgaggcgatggtgggacagggctgggtccatatccagcaaatacgtgcggtcgggcagcaggttgttggtggcccacatgcttaaggatcgaatctcttctggcgtgagttcgcggccaccggcctgataggccaaggaagagtctaaatagcggtcggtgatcaccacttcaccgcgctccaatgccgggcggatggtttcggcaacgtgctgggctcggtctgcagcgaatagcagcgcctcggcgcgcggtgcgatgtcgacggcgcccccatccacaccgtgcaacagcagttggcgaatggccttgcctaacgcagtgcctcccggctcacgggtaacgaccacggtacgcccctgagcctcaagatacgcatgcagccgctcgacttgcgtggtcttgcccacgccatcgacaccttcaaacgaaacaaacagaccgctcatgctattgaccttagcgttaggcgcagagttgcgcccaacaggcagttaaaccagctctacctccgtttcaaggggctgatttggtcttttctgaaggtctacttccgtttcgaggggctgttgcccaagtagacaacgttccaaaacggcggaatgacgttggcgcggagccgttcatactcgtggttcagcagatgaccagccccttgaagcggaagtagatattctcaaaacgagaaatcagccccttgaaacgcaagtagagcaataattccgctcagccacgcttgggaattacggcggggcgctcgtagccctcgttggcggtcagccagtcgacgtcctttttcacagtggcgggggtggaaccgagtttttcggcgatgcgctggttggaccagcccttgttcgccaacttcttgacttcggcacggcgttcggcgcgcttggcctcctgcgccgaaaccgcagccgaggtaccgcccttcttgcccttgccggcaacggccttggcgccaccagcacgcccagcaccgcgacggccacgggtggggggaccagccgcacgcttttcggcgagcagtcggaaggcgtcatcaggggtgatggattcaggcgtgtactgacgcggcaccgtgcggttggtctcgccatcggtgatgtacgcgccgaaacggccgtccttgatggtcacgttcttgccggtgttcgggtccttgcccaaatcacgcagcggcggcttggcggcaccacggccacgcccgcggccgtacttgggctgcgagaacagttctttggccttgtcgatatcgaccgtgaagatctcgtcttccgaggccagcgagcgggtctccgacttgccgtcggcacccgtcttggtcaggtaggggccgtagcgaccgttgttggcggccaccgtgcattcggatacctcgccggtttcggcgttggtttcctcgtatgtgcccacttcgcgcggcaggctcagcagctttagcgcgtcttccagcgacagcgattcagggctcatcgtcttgaacaacgaggccatcttcgggcgcgacgcggcggcggccgcggccttcttcgaacccttcttggccgcagaagcaccagcagtatcgccagcagcgccagccgaagcctcagccggcggcaccaacgccacatacgggccgaaacgcccattgcgcacctcgacggtaccgccggataccggatcaacgcccagctcgcgcggtccaccggagtggttgtcgatcaaatcgcgggccacggccaccgtcagctcatccggcgcgatggtgtccggcagagacgcgcgcttcgggttgccttcggcgtccagatgctccatgtcttccagatacgggccgtaacggccgacgcgcacgtgcaggccgtcgccgatgtcgatggtgttgatggcgcgcgcgtcgatctcgccgagctgcgcgacctgctgttgcaggccttcgtgcgcctcgtcggcgttgcgggcggcgccctcgccggaaccgaagtagaagtgggtgagccagtcgcggccggattcctcgccgtgggcgatgcggtcaaggccgttttccatctcggcggtgaactggtagtcgaccagcttggggaagttcgtctcgagcaacttggtcacggagaaggcgagccagctggggatcagcgcacggccacgctcgtatacgtaaccgcgatccatgattgtggagataatgctcgcgtaagtggacgggcgaccgatctccttggcttccagcgtcttgaccagcgtggcctcggtgtagcgggccggcggctgggtttcatggccgtccggttcgatgtcgcttgcctcgacctgctggccgacgctcatcggcggcagggaggtgttggattcggaggcgtcacccctgacggccttggcgtccgtcttgccggcggcagcagcctggtccgagccagccccagcgccgggagcggcggccttgggcttgcgcccctcccccgtggccttcataaagccggggaattcgatgacggtgccggacgcctggaacacggcctcgccctcggtggggccggccggcgcagacaggcgcacggtggcggtggaaccggtggcgtcagccatctggcaggcaagcgtgcgctgccagatcagcgtgtataggcgcagctggtcgccgggaagtttggaagccagctcgtccgggtcgtggaagcgcgagcccgccgggcgaatacactcgtgggcttcctgcgcgccagcggttttggtggcgtactgcttgggctcggcggagaggaacttgtcgccgaaatggtaggagacggcgttgcgggcggcggtgatgccctcctgcgacagcgtcaccgaatcggttcgcatataggtgatgtagccgttctcgtacaggctttgggccgcgcgcatcacggcgcgagcacccatgccgaggcgattgccggcggtctgctgcagggtcgaggtggtgaacggcggctgcgggcggcggcggtacggcttggtttccatcgacatcacagtgaaatcggcggtcttcagcgccgaagccacggcggtggcaccagcctcatcaagctggcgaacgttcgccgcgaacccgtccggggtcagctggccgtcggcaccgaaatccttggagccggcgagtcgcttgccgccgagcgcgatcatgcgggcggagaattcggcacgatcccccagcgcgtcaggcgcggacagcgtggcgacgatatcccagtacggcgcgcgcttgaacgccatgcgttcgcgctcgcgttccacgatcaggcgggtggccacggactgcacgcggccggcggacaggcctgggcccaccttgcgccacagcaccggcgacagctcatagccgtacagacggtcgaggatgcggcgggtctcctgtgcgtcgaccatattgccatccacatcgcgcgtgttgttcagggaggcgttgatggcgttcttggtgatctcgtggaacaccatgcgcttgaccggcacctcgggtttcaaggtctgcaccaagtgccacgcgatggcctcgccctcgcgatcctcatcagtcgccagatagagttcatcggcgttcttcagggccgatttgagttcgctgaccgtacgcttcttgtcgccgtcgacaatgtaatacggcttgaacccgtcgttgacgtccacgccgaacttgccgaacttggccttgtctgccgcgggcacctggctgggctgcgcgaggtctcggatatggccgaccgacgccatgacggtgtaccccttgcccaggtagtcaccgatcttgtgggccttggtcggagactccacaatcaccagtttggtagccatacccactccttatgtattgcgcgaaacacacgacgtttctggcgtcataatactcatgaatcatgtccaactgccaaattccgccgttgtgccgggcaaattcggccgttcgcaccccatgttttaccgtttgggcggtgccggcggagcgccgatcagacccagccggcttaagggcgctgcagtgatctgacgcagggccagcaacagtccgaatgcgagcatggccacacccgcaatgcccacaacagcgctgacattcgccccctgaaccgcccagctggcgctgacattgagccccggcaccacctgccagatcacataaccgctgtaggcgagcaacagcaggcccccggtaatcagcacgctgccgacgatttgcacgctcactgaggagacgcggcgacccggctcgtccatgccggacttgcgcgtaactgccagagcgagcagggccaatcccgccaccagcaggatggacatcgccacatccgaagggcgatgccattgtccgtatatcacggagacaccgacggtcaccgcccaaaccacgccgatgacgcccgccaaagctcgaaccgcacgaggcacggtaagcagcagaatcaccgcacaggctgcggccagcatcgtgtgaccggaaggcgcggaattagcggcaggcgattcagtgttgatgatgaacggacgcggcaacagacccttgatacgggtgacggccaagcagaccacggcgaacacggcgatttgcccggccaaccaccagcggcgtcgaatcagcgccgtaataatgccgattgcggcaattgtgcagctgacagcgataaccagccaggattgtgcgacggcgttcatcacgccggtggcccaggacggtacatcgttgtgcaggtttttccagaccagttcgtcgtacgattgtccgttttcggtaaacacgcacccccaccacacgccgaagccgatagcgatcaggagcagaccgaataccacgcacagtacgcggctggagattcgcgggcgcacggtaagcgggtcaagccgggccaagccgcggtcgatatcagatgccccatccgcatcgtccatgtccagcggcctgaaatcccgtaaggagcctgatgtggatgccgatgcatctgaaccggagaccgggccgagcgcagccaatgggtcaacaacgttcgacgacgagtcaggctgtgctgcgcctgagccgaccagattgaccgccgcatgcgggtcgcgaattctaggggtctgtgcgtcattcatacgttcgactgtacggccgcgccccggacaggggaccacgctagtgccagctcacagccaaatccgcacataaagaaaacctccacacacccgtcagaggccacttacccttgctgcattcctgccctgggggagttgggtgacatagcgccgcgtggaggctggggataagtctatggagacgtatggaccagcgcagcgacacgaaacgtgcgcgccgggtcgcacggcagaccaaccagcgcattcaggcaatattcatgcaacatcaagaagcgtgcccaattgtaagaattccggaaaaaataccggcataaatgcgtgtggttacgctcacgtcaaacgattgttcaaggccaacagttacggtggacaccatggcttcttatactcgtcgtgcacattcgggaggcaatggccccgctctgaggcaaccgcgcaccgcgcaaagcagagccggccactccgcacaggagggcccctatacgccccaggagagccgttcccgccacgcaagccacaaggcttccaatagccatcgagccccgaacaggaagaaaaagaacacaggaaaaggcaagcaccgtgtactgaaatgggtgctgggcatcttcttctccctgattggactgggcttgctggccggtatcgcagtattcgcatacctgtacaccaccaccgaggtcccgcaacccgaaaagttcgcgttggccgagaaaaccaccgtgtattacgcggacggcaccaccgcgatcggctcctacgcggaacagaatcgtgaaatcatctcttgcgaggggctgccggactacatcggcaacgcgattgtggcgtccgaaaaccgtacgttctacacggataaaggccttgatctgaagggcatcgcccgcgcattcattaataatgtgaccaagggcacgcgccaaggtggttccaccatcactcagcagtatgccgagcggtattacatgggcgaaaccacatcctatgtgggcaaggcgcgcgaggccatcatggccatcaaaatcgcgcagaccgaatccaaggacgaggtgctgtgcaattacatgaacaccatctatctgggccgcaactcctacggtatccagacagcggccaaggcatacttcaataaggacgccaaggatctgacgctgtctgaggcggcgatgatcgccggcattattccgtcaccgtccacgtgggatccggccgataacgccgatatggccaaatcgcgcttcaagcgtgtgctgaacatcatgcaggaggatggttacatcactgccaagcagcacactgatgccaagttcccgcagaccgccgcggtggcgcagcagaacgaatacgcggggccgaacggttatctgctggatatggtgcgccgcgagctggtgcagtccaaggcctttaccaaagaggatttggatactggcggatacaagatcatcaccaccatcgacaagagcaagcaggatcttatgcagtccatcggcgacacccgtctggacgacatgcctgaatccctgcaaatcggcggcatagcgctggacccgaagaccggtgaagtattgtccgtatacgccggttcagattatctgtccaagcagctcaacaatgccgatcaggccgtattcgaaccgggttcgactatgaagccgttcgctttgctgggggccgcgcaatccggcgtcagcttcgatacgttgttcaacggcaattcccaccagcacttcaccggcttggatcaagaggtgaacaacgctctggagaacaactggggcaacatcaatctgtatcaggccaccgccaactcggtgaacacggtgttcatgaacgtcaatgagcatctgacgccgaagcgcacggccgcaatcgcccatgaagcgggcattcagggcgatatcgatgaaaactccatgtacaacgtgctgggcatcaacgccctgaccgtgtgggatttggcgcaaggccattcgaccatcgccaacaatggcgtgaagaacaccttgcacatggtgtccaaagtgcttgattccaacaataaggacatgtacaacgcgcccagcaacggcaccaaggtgttcgatgccaacgactgcgctttggtacagaaggccatgcagggcaccaccacgtacggtacggcggccggcacatccagcatgttgggccggcccgtcgccggcaagtccggtaccgccaacgacgaaatggcttcgtcgttcgtggggtacacccccagcatgatgaatgtgtgggctatctggaatccggacgataagggcaatccgcaagtggtgccagccttctccggatacggcgtctcttccactggataccccgcccacctgttccaggagttcatggctcaggccttgcaaggcaccgaggtggagcagttcccgaccgctaaagacaacggcaagatcggcggctccgacggcacttggggcttgggcaagggacagagcaacggcctgtccaacaacaccaacaagcagtccaccgaagacgcgcagaagcaggctgagcaggacgcacagcagaaggcggccgaagaggaagccaagaagcaacagcaggctcaggagttcgcccagcagtgcctcgccaatccgagctattccaccgagtgcccgaattatcccgacaccactaccggcggagatggcaacgccggcaacaataccggcggtgacaacgggaacaataccggcaacgataatggtaattccggaggcaccggcgggaacaccggcaccaacggcgtcacccagtagtaagtaaaacacagacaacaaggctccccctgatgcaatcagagggagccttgtttttgttctgttagcgctcagcgcttgcgctgggaacggttgatggcggagataatcgacttcagggcgctagtggtaatcgacgaatcgatgccgacgccccacacgatctgcgcgtcatcggcctcgccgacctggcattccacgtacgaggcggccatggcgtcggtgccgacggacatggtgtgctccgcgtaatccataatcgaggcgtcaacgccaaagttggaaatggcgttgaggaaagcggcgatcggaccgttgccgatgccggagacctcgcgctccacgggcgcatcgaccccgacgttcacgccgcggtcgagcagacgagccttgagcacggtgtcggagccatcctcaccggagctgacggccaccttgagcagcttcaagcggccccacggcacgagcgaggcgtcatgagtatcgcccacaaccacaccggcggcggtcatgccggactgttcgaccggcaggtactcgtccttgaacagacgccagatatcctcgtccttgacttccttcttggtcgtgtcagcgtagttctgcacgatcttgtcgaattcgatctgcagacgcttgggcaggtcaagattgtggttggtcttgagcaggtaggccatgccgcccttgccggactgcgagttgacgcgaatgatggcttcgtacgtacggccgatgtccttcgggtcgatcggcaggtacggcacaagccacacgaagctgtcgagatcggcgccagcacgctcggcggccacctgacgagcctcgagacccttcttgatggcgtcctgatgcgagccggagaacgcagtgaacacgaagttgccggcgtacgggtgacgctcggaaatcttgatctggttgcagtactcaaccgtcttgcgaatctcgggcacgttggacaggtcaagctgcgggtcgatgccttgggtgagccagttgaggcccagcgtgaccaagtcgacgttgccggtacgctcgccgttgcccagcaggcagccttccacgcggtcggcgccggccagcacggccagctcggtggcggccacgcccatgccttcgtcgttgtgcgggtggagggagagcaccacggagtcacggtcgtcgaggtgggtggagacgtactccacttcgtcggcgaacacgttcggcgtggtcatttccacggtggcgggcaggttgatgatcatcgggtgctcgggagtcggcttgataacaccgatcacggcgttgcacacctcgacggcgtactccggctcggtgccggtgaaggattccggcgagtactcgtagtacaggtcgatgcccttggcctcgttctcgaggtccttgcacagttcggcggcgtcggtggcgagcttcttgatctcctccttgttcttgcggaacacgacctcgcgctgcaacacagacacggagttgtagaagtgcacgatggcgcgcttggcacccttgagcgcctcgtaagtgcggcggatgaggtgctcgcggcactgggtgagtaccacgatggtcacgtcgtccggaatcagctcacgctcgatgagcatacggatgaagtcgaaatcggtctcggaagcggacgggaagcccacctcgatctccttgaatcccatggagacgagcaggttccagaaacgcagcttgcgctcggaatccatcgggttgacgagggcctgattgccgtcgcgaagatcgacggagcaccagcgcggcgcgcgctgcagtcgcttgcccggccacgtacgctccgggtaatcaaacgggatctgcttgtcgtaggcggcgtacttgttgtacggcatacgactcggcttctgcggatcgccaatgaatcgcgccggaggcagcagcgggtcgttgttccccccattggacgctgcagccactgccgcgagatcaaaaacggatgattgaccctgacccattgttcctcctttactggttattgcgcgggccctcttgcggacgcgactgcggcgttgtgccagggcggcgccgggccacgcggatttgtcaatacgcacgtaacatcctacaggccggttcgggcaaacccgcgggaaatgccgtatcgtggcatttgcttatgcacctggctgacatgagggcactcagcgtcggcgccgggccacgctttgactccggcacaacaccccgcctgcgataccccaccagatggccctccatacgtcggcggcgggccaaatattggtactgcaccgacagccaaacggctcagcgtcgtcagcggaccaacttatggcgaaataccgactctgggaaagcttatcgtcggcaaattgccaggctatggcacactaccgacgctacgaggcccacaaccatcggcaacgcgacaaatattggcccaccgccgacgctagcctctttgagcgtcggcgccgggccattctatgaatcagtaacgacgccaatggtctcagaacgtcagcatagggacgctgtctggatctccaccgacgctgcatgacaaaatcgcggcaccatcaagcaacaacacggctgcggcaccccgccctgccccgtcccttgctgtgccagtcctgtgaacgcgcgggcgatccgccgcccggcaacatagactgaagagctatgacgagcttgcgattccgcgaagacggcagcttccgcgtgctgcaaatggccgacgtacaggacggccccgatgtgttgcccgacaccatccgcctcatccgcgaggccatccgcgaagccgatccggatcttgtggtgttcaccggcgaccagatccgcggctatgatcccgcctacatcgacacgttcctgcgccgccgcggcgaagagccgggcgctcgcgtgcgcgcggtcaccgagatcgaggccaaaatccgcgggatcaagcgtcaccccgtaattcgcaaaacatccgatcgcgtggccgatcgtctcaccgaagccggcaagcctgtaccagccgcgctgcttgaccccgataccgtgacgaacgccgtcgccgctgccggcgccgattcgaccgacgtgatcacgacttccgaagtaggcgattccgttgagaccagccccacgcccgagacggtttccaccctcgtatattcaacgcaatccggcaaggccagccccgcacacgagacgccggcgaccctcgacgaactcatgattgagacccgcgaaaaggtccgccgcacgttctccggtttccttggtccggtcgtcgaggccggcgtgccctttgccgccacctacggcaaccacgacttccaatgcggcattctggccgacgaacaggatgacatctaccgcgaataccccggctgcctgaaccccgacgacagtctcgagcccggcacgttcgcgctgcccgtcgagtcctccgatggttccggccgcgtggccatgtccgttatgatggtcaattcaggcgattatgccggcaaacccgaagaaaacgacgcccaatacccggcgtatgtggtcaatccgcgaggactcgacctggccgacgccgacgggtacggcacccccacccccaaggccatcgaatggctggggtccgtccaaaccgagttgggcgagcgcaatggcgacggcaagcccgtgccggccatcgccttccagcacattccgccgcaggaattctacgattgtctgaaggaagtgcccgcatggacgccgaacgccgtggaaggcgcgcgcacgcacgccgggcgttgctatgtgctcaaccatgaggtctgccgccccggctcgcggctcggcgaggcgatcggctgcgcggacgagaatgtgggcgaggtggatgccttgcgcgaggctggcggctatttcgcgctgttctgcgggcatgaccataagaactctttcgttggtcatgtgcatgatatcgatctgggctatgcacccacgtgcgggttcgaatgctatggtcccaagtcgcggtaccgcggcattcgcctgtttgaattccatgagagcaatccggcgggctatgtgacccgcatgctcacatggggtaatctggtcggccgctactccagcaacgagctgcgcgtctggttcgaggatcattgcgttaccggagcggtcagcgcacgcaacgagctgcgccgcccgcaggtgttcgccgtggtggccggcgcgatgagccttggctttatagccatcatccgttcgctgatcaaggccgcgcgctaaacctacttaaacagactcaccccgcgacgggccgtgcaatacgcgttgcccagccaagtatggcgggaattgggccagacggctcccagtcgcggtgcgttctggctcatccagatgctcggcacgcgtccgtctgcggagcgtgagccgagcagattgaagccgttcttttccagcagccactccgggtgctgggtggcgatggccaagccttcctcgagggtgagcggcaggcgctcatcggagtcaataagtttgcgggccacatccggctcgcgattgacatagcacgtgccggtgtgcggattgacgaccagatagaacgggccttccggcggcatgaagccgtcttgaggcaggaagctggcgatgtcacgcggcggcatggtggtgaagcctgccatgcgattgatggaggttcgtgcaatcagcgactcaggcgaaaccagttcacgcgtgggcaccagcaggatgttcgatcccaaatcggaatgctcgagcgccccgatcagaggtcgggccagcgagcggaatgcggcggcggaaatatccgccacatccgggtagccgagagccacgatacggtcgagctgtttttgggcctctactgatgcgatagacatggctaccagtgtagaacatcgccttcgcttcattgggcagccaccatctgggaagaccactgccgttgttccgcgtgtttcgtacaattgcattgttttacggccacccgcatgacggccgtccgacgtaagtaatccatcgaaacccagaggtcatagaggtcatcatgtccgaaaaattgaaggtcggcatccttggtgccaccggtatggtcggtcagcgttttatcacgctgcttgagaatcacccgtggttcgaggtggtcacgcttgccgcttccgcgcacagcgccggcaagacgtatgccgaggctgtcggcgaccgttggaagatggaaaccccgatgcccgaatatgtcaagaacatggtggtcgtcgatggcgacgatgccgagtccgtggcctctggcgttgatttcatgttctctgcggtaaacatgccgaaggaccagattcgcgccattgaagagcgttatgccaagaccgagaccccggtggtctccaacaacagcgcccaccgctggaccccggacgtgccgatggtggtgccggagatcaacccggagcacttcgaggtgatcgagcaccagcgcaagcgcctgggcaccactcgtggttttatcgccgtcaagccgaactgctcgattcaggcctacacgccggcgctggccgcgtggaaggaattcgagccgcgcgaggtggttgtgagcacctaccaggcgatttccggcgcgggcaagaccttcaaggactggcccgagatggtgggcaacatcatcccgttcatctccggtgaggaagcaaagtctgagaaggaaccgctcaaggtgttcggccatgtggacgccgccaagggcgagatcgtgccgttcgacggcgacctcaagatcacttcccagtgcatccgcgtgcccgtgctcaacggccacaccgccaccgtgttcctgaacttcggcaagaaggccaccaaggaagagctcatcgaccgtctggtgaactacacgtccaaggcttccgagctggagctgccgcacgcaccgaagcacttcatccagtacctcaccgaggatgaccgcccgcaggtcaagctcgacgtggactacgagggtggcatgggcgtttccatcggccgtctgcgtgaggattccatcttcgattggaagttcgtgggtctggcccacaacaccctgcgtggtgcagccggcggtgcccttgaatgcgccgaaatgctcaaggctctcggctacatcaccaagaagtagttgaaactgagtccgaaactgagaaagccctccgcaaggagggctttcgtcgtatataccgcaaaaacgcggctcagcggctcagcggccagtaccgccgtacaccacggcttcgatttgatcggcatcgagaccgtatgcggtgtgcagcgccttgacggcgtcgttgagctgatcgagcggcacgagcgcggcgatacgaatctcggaggtagaaatcatcagcacgttgatgccctcatcgctcagggcctggaagaacttggcggccagaccggcatgggtcttcatgccaacgcccaccacggccaccttgcctacgttggtgtccacatcgaaggagtggtagcccagcacttcctgcttgtcgagcagtgtgttctgaacctgcttgacggccgattcgggcacggtgaaggagatgtccgcagtgccgacggatgcgccggcctgcacgatcatgtccacgttcacgccggcggtggccagctcggtgaataccttggcggccatacccggctcgttcggcacgccacgcacggtggccagcgcctcggaacgatcgtgggcaatgccggaaatcaccggtgcctcggggcccaggtcagggaacaggtcgcccatggatttcgcttcttcttcagtcatgtcttgccttgtcttgcttgaaattacttacgattatcgttcgctgtagccgcgctcagtcgaggttcggcagcgtacgcgggtcaatgccgtcgggcaccaccaatgtgccggggcgacgggagaacgaggaacgcacgtgcagcggcatgttgaaacgctgagcgtattccacacagcgcagtgccagcaccttggagccgcaggacgccatctccagaatggactcgtaatcgatggacggaatgcggcgggcggaaggcacgatacgcgggtcggcggtgaagatgccgtccacgtcggtgtagatctcgcagatatcggcaccgagcgccacggcaagcgccactgcggaggtatccgaaccaccgcggccgagcgtggtggcgtcacccttggcgttgatgccctggaagccggcaacgatggcgatgtctcccaatgagagcgcgttcttcacgcggtccggtctcacggccttgatgtgggccgcgccgtaacgggcgtcggtgaagaagccggcctgctgaccggtgaaggagtgggcacggctgccttcggcgtgaatggccatggccagcaggctcatggaaattcgctcgcctgcggtcatcagcatgtccatctcgcgctcgggcgggttggagtcgatgctcagcgcctgatcgataaggtcatcggtggtgtcgcccatggcggagaccaccacggccaccttgttgcccttcttttccgtctcaacaacgcgcttggccacacgtttgatcgattcggtatcggcgaccgacgaaccgccgtacttctgcacgatgagagccactgctgtcctttgttcttctcttagggggagtttgctcaatattctacgcaaacgcaacgattataaaggttgccgcgttcaccccgcgaccccgcgccgacatgtggacacgggcatggcctacgttgttcagcaaatattcaagttttcaccggtggttctttgaggcagccgcatccatcctttgagattcgagcggttaactatcaattaccggcaaacgaaagcaaaccggcgaggtttccgcagaccccataactgaataccttcttcttcctctctccttttcaaggcccggtcccgcagcccgggccttttccttttgtgttgggaacgatgggtcaaacgcacgctacgagctcacggagcaagcgtggccaacggcactaccaataccccatcatcccggcgataagcggcagccgtagcggtcagcaccatcaagaatgacggacggccttcgtgatcttgatcaattctgtcagccaactttttcaaatgggccgccgcaatatcaacctgcttttctccgagcttgacctcaatgagagcccatcgtccatcatgcaggccaatgaccgcatcagattccaatcccgtcttatcccgataatggaacacatctccgccaagcgcatcagcatacacacgcagatcgcgaatacacatggactcaaacagcaagccaaaggtctcgaaatcattaaggagtttctccggggtcgcgtgcagtaccgcacaagctatcgacgggtcgctgaagtgtctggttgggctcgttctcactgcagtcttagaacgtaaacgagggttccaagctggaagatcttcagttacgcaagctcgcgacaatgcatctaaataatcggagagtgtaccttccgaaggcggttcaccctgcatatccgccgcgatagtggattgcgacgcctgagaagaaatattgcgcgcatacgagcgcataatcagacgcatccaagttttattgcgctttataccatccatacgattgatgtcagaatcaagtagttcttcgacataatccgcggccatgcgcaaggcaacatttactcgagattcgactactgcttcaggccagccaccgcggcatagcgcaaacgcggtgttttcaatatcgaaatcggagaaacccgaaacatcatggttgccatcgaacaactctcccaacgaaacaacgcccgtcgattcctgcgattcaaataaggacatggtacgcatggttaatcgggcaattcttcccactccggaatgagctggttcctgttgaggagtcgccgatccagttaggatgaatcggccacgaccgcgccctcgatcgatggcgaaacgcaccgcgtcccacaattgcggggccatctgccattcatcaatgagtctcggctcctcacctcgcaggatgagagaaggctttgtatcagccaaggccaacagcgtagcactgcgatccgggtcctgcatgaagacctgactcgccgactgcctttctgccgttgcagtcttgccacaccattttggacctttaatctgaacggcaccagaagactgcaatgcctgagtcagcaacccatcagccactcgaggaaggtactcgccacgttgaatctccgagctctccactgccatatgtgccctcccgcaaaccatcgaaacatcaacctataaatcactctattgcggaagttggaccattctaattgtggaagttggactattttcgttgtggaagttggaccattcctattagggaagttggacactagattacgaactagacttttcctttttgcagcaacagtgccaccaacacgatgggcgtcatcaccgcctatcgccagacccttttccttgacctaaaaagagagatgcccagacagtgccatcttttctctgatcacactagccaattcggaacgcagcggcgaatccgtgatccgcgcatcctctgcaaccgcgcctttgacgttcggcaatccggcgaatgagcttttgctcaggcgttcttcgtgattcatttctttggtcggaaaacagaatacgcgggaacgccacggggctgtcctaaacctgaaatcacgaggctacgcctcgatttcaggcttgccttcttcagcccacagcgtgtggaacacgccgggcttgtctacgcggccgtaggtgtgggcaccgaagaagtcacgctgggactgggtcagagcggtgggcaggcgcttggagcgcagaccatcgtagtacgccagggagctggagaacaccggggtcgggatgccggcctccaccgcgcgaacgatcacgcgacgccatgcgtcctgcgattcgccgatgatcttctcgaagtacggatcgaacagcagggaagccggcgggttatcgcccttgaaggcctcggtgatgcggtcgagcaggaactgggcgcgaataatgcagccgccacgccaaatgcgggccacttcggacaggttgatatcccagccgtattccttggcaccgtcctgaatctcgttcaggccctgagcataggccacgaccttggaagcgaacagagccttgcgcacgtcctcgacgaacgcggccttgtcttctccggccagatcgatggtcttgttcggtccagccagaccttccttctgagcgtcttcacgcagctcaccgtgcgaagacagtgcacgagcgaacacggcttcaccgatggcagccacaggagaaccaaattccagaccagcctgcacggtccaagtaccagtacccttcatgccggcatgatccacgaccacgtccacgaacggcttgccggtctcggcatccttgtggtgcagaatctcagcggtgatctcgatcaggtaggaatcaagatcgcccttgttccattcagcgaacacgtcgccgatctcctcggcatccatgccgagtccacggcgcagaatgtcatacgcctcaccaatcacctgcatatcggcatactcgatgccgttgtgcaccatcttgacaaagtggcctgcaccatcggtgccgatgtgggtcacgcacggttcgccgttcaccttggcggcgatggactgaagaatcgggcccaaggtcttccaggattccgcagtgccgccgggcatcagagacgggccgttgagcgcgccttcctcaccaccggacacaccgcaacccacgaagtggaagcccttagcacgtacttccttctcacgcttgatggtgtccttgaagaaggagttgccaccgtcgacgatgatgtcgcccggttcgaacacctcttccagctgcgcgatggtcgcgtcggtcggagcaccggccttgaccatgatgatggcggtacgcggacgcttcagggacgcggcgaattcctcgagcgtttcggccggcacgaagttgccttcggtgccatgctcgttcatgagcttctcggtacgcgagtaatgacggttgaacaacgccaccgtgttgccatggtgcgccagattacgcgccagattggagcccatcgtggccagtccaatcacaccaatgtttgctgtagcttcggccatgtgccttgcctttcgtttgattgtcccatcgtcatcacgcgcgtcacaaaacagcgcatcagcggagggaatcattccttcaacgcttgaaagtgtatcccgcttaccacccacacgcgagggctgtcttaggttctacgcaccttctgcccgcgaagcgtaattacttgccggccattcacatacgcccggccttggaagggtcgatatgcatggtctggaagcgattggccatgtaagcgtcgctgtagcgttcgctgaaccacatcgcgaccggtgaatcctgcggctggccggccatgcgcccataccagcaatccaaggccatcagcgtgaaggcaatgtcgatcaccatcagcaccgtgcataccgcagtcagcgaataccgcactttccatggaatgcgattaatcagagccagcagtcgcggtaacagccacttgacccacaccacaccaatcagtccccagaagaacatgaattggcccgaagtacgtccgtcgatggacagccaacggccggtgtaatcccacgcggtaataccaaacgccgcttccatgaaccagctggtgcaatattcgaacgcgccgccgatcaccgccgaagcgcagaaaatcaagaacggattcgccttccacagacgattcaggcacacggttaccaataccgcaccacagccgtaaatcggcgagaacgggccccacagcaaaccagcgcggtcctgaagttcaccgttatacagcgccatatggtagatcgtctccacaatcaggccacccaccgaagcgatggtaaacagccagaagatattgaaaaagtccagcgcaatatagcccttgccggactggtcgcggcctagcatgccggccgccacagccgattcataatcatcgcgatcgtccatacgcctgagcgcgcgccgcagacggcgttcctcgctcagggagggatcggcggtcaccgaaatcacgacgagaataatcatctgaatcagcggcagcagcaggttgaagccaaggccggtcagggccagcgacagcatgccgtcggccaacgtcaacggcatcagcacgtaggtccagcgcgcggcataccggcgatgattgcgcagcagcatcacgccgagcacaatcaggcatgcggcactgactaccagcaccaccgcatgaatcgcggacaggatgaaggtcaggctcatcgcatcgacgtgcacatgaccatccagaatctcgcgcacggcatagaggatggaaatcaccataatcggcaatgtggcgagtccgtccagcagcacgaccgcgccatagatgcgcgccagaatcggtaatcgcttggcgttcaggttcaagccggcgtcgtccagttcgacggccaccagatcggccacgactgcggactcggcgtcacggttctcccgcggcttgccgggggtagtggccgtgccatcgtccttgaattcaaccatggtttcctccccacatagcgtcccctcaccctatcacccgattgcggttttgctgaacttgatgggcggtcggtacatgtctgtctacattgccgagcaccgagcctatccatcgcgttcaggaaacgtccaaaaaccatccagaaatcttgtcaataagttccagaacgcctttcgctctgcccagcgacacacgataagccgctgggcagcagcgttattccgccaaaaacatcatcaatcaccccattaatctccggcagtcgtattacgctactacaaacgtagcgctacgattaacgtatcgctacggaaaacgtagcaaccaagcaacaccaagctccggaggtatcagtgggcaatatcttcaaggtcctcagacgcgacttcctgcgcctgttcaaggtgccggccgcatgggtgatcctgttcggcatggtgttcatcccgccactgtattcgtggtacaacatcgtcggcttctgggacccgtacggcaataccaaaggcatcaccgtcgccatcgccaacaatgacgacggcaccgacaacgcgctcatcggcaagcagaacctcggcgatcaaatcgtcaagcagatgagaagcaacgaccagctcggctggaccttcgtcaccgaagccgaggccatggaccaagtggaatccggcaaggcatacgcagccatcatcattcccaaagacttttccgacgatctcgccggcgtggtgaccggcggcaagagtcggcccactctggagtattacgtcaacgaaaaagccagcgccatcgcccccaaagtcaccgacgtcggcgcgtccactgtggaccgcacggtcaattccacattcgtctccaccgtatccgaagtacttaccgaagtcatcaatacggttgacggcaaagccatcagtaccgaagacaccaccaaagccaaggccctcacggcccttgccaaggcctccgacgatgtgcagcacacacgcagcaccatcgccaagctcaccaccaaactcaccgacaccccagagcagacacgcaccgcacgtcaggcgctggacgacgcgcgcacacttggcatcgacactgcagaaggtctggccggcgtctccaccctgatcggcactacccagaccagtctgaacggcttcgtcacctccacgtccgaagcgcttgaccaaggctcaagcctgctgagccaagccgcagcacaggccaaccaaagcgtgggcacggtaaccggaaccatcagcgccgccaatcagcaggtaggcggactgatcaatacggcggaagacatcaaccaagcgaacgccgacatcatcgaccaactcaaagggctgccgaacgccaatcgagaaccgctgcaatccgccattgccacactggaaagccgcaatagcgagcttgccggcgcactgggcaacctcgatagcctgaacaccactatcggcaatgcctccacagacaccgccggattggcgcagcatctcaataccgccacccaaaccacggtgcgcgaggccaataccgctcgcggcaccatcacctccggcgccattcctcagctcaacaccggtctcaacgccctcagctcgaccgccagcactctgtcgaccggcatcacgtcgcaaggctcactcatcgatcagtcgaagcataccctcgaccaactcgacaaagcagcctccaccacggtgaccgcgctgcgcgacaccgataaggcgctggccggcgtacaaaccaagctcgatacgctggtcaccgacatcaaagccctgagcatctccagttcactcagttccctgatcggcaccgacggcaaactggatgccgccacaatcgccgacttcatgctctcccccactgttatcagcgaacaggccgtctacccggtcgcctcctatggttccggcatggcaccgctgttcaccaccctgtctttgtgggtgggcgcgttcgtgctcgtggtcattcccaaactcgaaaccgacgacgagggcatcgacgatctcacgccaacccaaggctatctcggtcgcttcctgctactggccacgctggctgccgtccaaggcctggtcacggccatcggcgatcttgtcatcggcattcaatgcgcgagcgccccagtgtttctgctcacctgcgtcatcacctcactggtgtatatgtcggtgattttcgccctctccaccacgttcatgcacgtgggcaaaggcgtgtgcgtggcgctggtcattctgcaggtgccgggcgcctccggcctgtacccgattgaaatgatgcccgcgttcttccgcgccatctacccgctgctgccgttcacctattcgattgacgcgatgcgtgaaaccatcggcggcttctacgacggccactggttcgcctatatcggcaaattgctggttttcgcggttctggcctttgcgcttggcctcggcgcccggccgaaactggccaatctcaaccgcctgttcgcgcgggaaatcaaggaaagcgacatgattatcggcgagccggtgcatctgcccggcagcgaataccgtgtcactcaggccattgcagcactggccgaccacgacgaataccgtcatgccatcgaacgtcgggccgccaaattcgcctaccgttatccccggctgctgctgggtgcgcttattgccggattcgtggtgccggccgcgctcattatcgtgtttgcgctgaccaccagcgagaaaatcgtagtcatgggcacatggctggcatgggtgctcatcatcatgggcttcctgatggtcgtggaattcatgcgcgattccatccgccgccaaaccgagctcggcagcctctccgacgagtcgatccgcgccatgctgtacgggcataaggccaagcgtcgcgacacctccgccgaacgccacgaagaagcggacccgagcgccgctgttaccgcaatcatccccactattccgccgaccaaggaaggcaggcacgcacgatgaacaccatgtggaaactgtttaccggcgacatcaaacgcctgaccagcaacgtggtctccatcatcatcgtgatcggcttggtgatgattcccggcctgttcacctggttcaacgtggccgcatgctgggacccgttctcgaatatgaagaacctgaaattcgcggtggcgaatgtggatgaggggtatcgttccgacctgatcccggtgaaagtcacggtcggcgatcaggtggtgaacgcgctgcgcgccaacagtcagctcgattggacgatcacgtccaaagccgatgccgtcgagggcgcacgatccggcaaatactacgcggccatcgtaattccgaagtcgttcagcaaagacatgatgaccttcttctccgacgacgtgcagcatgccgaactgacctattaccgcaacgagaagaagaacgcgctggcaccgaatctgctcaacgagggcacggatgaggttgcggcggaaatcaacaccacgttcgctaagaccatcacttcggccgggctggaaatcgcgtcttcgctggccgatcagctgtccaagcccgaggccaaagagcaactgaataccttcaacgccaacatcgccaatttcgccacacagcttgacgatactgcggatctgcttggcacatacagcgcattgaccgatacggccggcgccttgctcgacacctcgaactcactaatcactcaggtttcctctgccgccaaacaaggcggcaaggatcttgccagcgccaaacaggaagtcaccgacgtggccggagccctgggcaccaccgctgacgcgatgagcagcgcactggacgcgagcgcctccagtttcggcgcggtgtccgactccatagacaagctgtattccgacgcgaatgctggtgccaccacggccgccgacgaattggaccgtcaagccacggccattggcaagcagacggagaaatacactgaaattcgcaacacgttggccggcatactgggcaacgactcatccatcatcacggcgatcgaccgttcaatcgcacggcaaaacaggctgcgacaagcgctgaatacggcggcgaccgatattcgccaaggcaatcaggacgcgcaggatcagcatgcgcaggtcaagaatctggctgatcaagcacagaacagtattgccaatatcaagtcagatttctcggccacggtgaaaccgcaaatcgactccctgtcgtccacagtctctggtgcctccggcatactgagttccggcgccacccagttggactccacgctcggcgacctgaaggggacttccgacgacgccagcgatatgctcagtgacgctcgcactaccttggacaaggtgtccggcaaactgcgttccgccggtgccgaactggcttcgttcaacagcacactgagcgacgcactaaacagtggcgatatgggcatggtcaaagaggtgctgggcaatgatcccgaaacgctggccagtacgttggccgcaccggtgcagctcaggcgcaaggccgtattcccggtggcgaatttcggttcgtcgatggcaccgttctacacgctgctgccgctgtgggtgggcgcgctgctgatggtggtgacgctgaaaaccaccgtgtctcgccggacgcgcaaagcattgggcgatccgcggccgcatcggctcttccttgggcattacggggtgttcgcgctgattgcgctgctgcaatccacggtgtcgctcggtggcgatctgctgttcctgcgcgtgcaggccgtgcatccgctgctgtttatgttgtctggatggctggcctcgctggtgttctcgttcttcacctatacgatggtggtgagtttcggcaatgtgggtaaggcaatcggcgtgcttatgctcatcgtgcagatttcgggtgcgaacgctgcctacccggtgcagatgttgcccgacttcatcgccaaagtcagtccgctcttgccgctcacccatgcggtgacgatgatgcgtgcggccatcgccggcatctacgacatggattactggcgggccgccggaatgctgctggcattcgtgccgccgctactgttgcttgggctgttgctcaggaagccactggtgcggttcaaccagtggtatgtagcccaagtcgagagcactaaagtgctgagctagtaggtattatccgggagttgcctacaaacggcatggacttaccaccctcagtctggctttgccagccagctctcgccagcgggagcgtacgggagcatatttcgaagagaagagatgacggagatgacagacacgacggcgacaccgcgcggtgagcgcacgcgcgaggcgacggatcgcaagctcatgcgagccacgctgcagattgcggtggaccgcggcatcagcggcgtgaccatcgaggaggtggcccggcgctccggtgtggccaaaaccacgatttaccgccgatatcataatgccgacgagctgctgcacgagatcagcgcgatgtatctggccatcccggatcccgacccagtgcccagccccacgcgtgagcatttcacgcaactattgcagcgattggtcgattgggtgcgcgacaacgacatcgacgtcaagcgcgtgggcattgtgttgtccagcgaggccgagttcttccagcacatcgtcgaccaggtggtgaccccgtggctggagcatgtgggagcgttcctcaagcagggagtcgcgcagggcgtgtttcgcgaggacgttgacgagaagttgctgttgtccacgattatcggatctttggtggcgtatgaggccatcgagggcaaagcaatggacgacgacaccgcctgggcctcgcgcatggccgatctgctgtggccagcattgctgaagtagcggtcttactcctgaatcgaagcctcctggcgggcgacttcgagggctttgttgaaggcgtcggaggtccaactggcgccggcgaccttgtccactttgagacccttcagaggtttaccgtccaccacgccgttaatggctttggcgaagtcgtcctgatggttcttggaaatcgtggtgaacgggtgcccaatgatattgacggtctcgacgttgccgtccttgatggtcagatggacgtcgatggaatcctcgcctaccgggccgtactggccgttgatcgagtagttgccgtccttgtagttgccggtgtccttcttgtcggacgtggtggtggacgggtcgttgtgcgacgagctggaatcggagccgtcggagctatcggagccgttcgactgggattgcgactgctcttcctgcgacttctcggtctcgcccgagttgccggcgtacgcatcgtccatcggcgcggccttggattcgccgcatccggccagcagcgcgccagccacgaccagtccggccgccgccaatgtcgcggatttcttcaacgtactcttttcggtcatattcacgctccttaagcccccccctctgacgagggggctgtcagcgaagctgactgggggagagaccatcagcttgccatgtattcctcacatactgctcgatgcccctgacggccctactcctcgccgccggttttcgcggccttggtggggtcagtgaaaccaatggcggtctcgccgttctgcgcgccctcgacctgtgcacccgtggaggcgggcttgccgccggccgcctcgtaggccttgcgcgcatcctcgtcattccacttctcaccgacgagcacgccatggttgagcatgatctcgcgctgcgcgcagctggcgaccagcgcatcgtgggtgaccacgataatcgtggtgccctgctcgtgcagcttgcggaacaggtcgagcacgattttctcgttcttctcgtcgaggttgccggtgggctcatcggccagaatcagcttcgggtcgttgatcagcgcgcgggccacgcacacgcgctgctgctcgccgccggagagctggccgggcaggtggtgggcgcggtccttcaggccgaccttttccagcgcctccatggcctgcttctcatcgaccaccgaatggtagtactgggccaccatcacgttttccacggcggtcaggtgcggcaccagatagaacttctggaacaccagtccgatgaggttcttgcgcacgtcggccagctgcgtggcgttcaggtcctccagcttgcggccttccagcttcacggagcccttggagggcgtgtccatgcagccaatcatgttcatcagcgtggtcttgcctgagccggaggagccgacgatggcgagccattcgccttccggcacggtcagattgaggtcgtccacggcacgcaggtcgccgtagatcttcgagatgtggtcgagttcaagtagcatgacgtttctctttctttattcttcgcgaagcacgacggcggggtcgatgcgggtggcgcggtggacgggcgggatggaggcgacgatggcgaccagcgcgctgaacagcacggaaatcagggccagccaccagttgaatacgatggagcgttcgaacaccgccacgcacagccaactggcgagtccgtagccgattgcggtgccgatgaggccgccaatcaggccgtagagcgacgattcgatgtagaactcggtgccgatggcacgcgagctagcaccgagggccttgcgcaggccaatctcgttgcgtcgctgcgagacgatcgagctgattgtggtgccgacgccgacgagcgtcagcaccagcaccaccagcgagacgatccagaacagcgtctgcagcatggtgatgatgcgggtgtcggaggcggtgatcttggtgacctgctgtgccttgacgtgcatggaggtcatgtcgttgatgctggacaccaggcctgcgaggtcgctggcgccggccgaatactcgatgacgtccacgccgcgcgtgatgccggtgagcttgttgacgtcggcgttggtggcgtagatgatcgagtcttcgctgccgccggtgtccacgatgccggccacgcggaattcggtaccggaggtgtccatgatgtcactggagacacggccgtctttggtttgctggtcgatcgaggagttcgacgaagtgccgttggtgctggcgttatcggatgcacggtagccgatggtgatggcggagccgattctcaggccgatggcgtcggcgatgtcgcgtccgaccagcaccttgccgtcggtcggccacgagccgtcgaccacccagtgatggttgaggttcttgacctgcgccgcattcacgccggccatcacgtacggcgaggcgttgacgcgcacgttctcgtagcggtaggtggcgtatttcgcggaacccttggccttgaccatttcagtggtgtgctgcaccatcgccttgtcgatgccggccttgccgtcagcattggtcgattcggtgggcgtgacaatcaggttcgcgccgtacgcacgcatctcctcgttcatctgctgcggcacagcgaggcagatcatcgccagacagaacagtgtggctgcgccgaccagcgacgccaccacagccatcaccgcgcgcgaacgccgacggaacacggcgctgaacagcattctgaagaacataccggtgttggtcatcggttccctccttccacacctacgtagataaactcagcgaccatggagcacctccgcgggcttgagattcagaatcgaacgaatcgatgaggcggacgccagcagcacggtgacagccagcagcacgaacaccagcacgaacaccatcggccgcatcgtaatgccggaaccgaacaccacccggcctatcagctgggccacgccggaaccgagcagcgcgcccacaatcgcgcccagcagcgagattgccgccgtttcggccagcatcaggcgggataccgcggcatcggtggcaccgagcgccttgagcaacgccagctcgcccgaccgttcgccgatcgaggcgaccatcaggttggccacggccacggctgcggcgatcaggctcagcacggtcatcagaatcatcacggcctgcgtcttttgcagcacattgccctgcaacgcggccacctgacgcacctgcttggccaccgcgcccggaatcacctcttcgatctgataggcgatcgagctcgggtaggcggtgcagtaccaggtctcccattcctcctggctcagcgcggccgggttcgcggcggccttacgggccaggtcgttctccggcgtggtcagggccttgacctcgattttgtcgaccgaatcgggcaggtcggcgagtacctgggccgtggaggaggcgatgtagagcgagccgttgtcctcgtcgccggaatcgtagacaccggtgagcttgattttctgctcgttcttcttgcctgaggcggtggttttgttgagggtgatggtgtcgccggtggtcacgccgagttcggaggccagcgtcttgccgatcacgccctggtcggaatcgtctttgggccacttgccgtccagctgccaccacgagcgcatgccttccacgcccacgacggtagtctcgccggtggagatcttgaggttcttgttgaaccacgtgccgacgaccggcacgttggtaccgttcaccgtggcgtggatgttgagctgcggcgcgaagctggtgatgttgaacgaccagaagatcgtcttgatcttggccgcgtccgactccttcagaaaagcggtcgggtcgctggtggacgtcgcgccgcccgactcggtgttgtacaggtcggaaacgaccgcatccgccttgggctgcacggtgatgttcgaaccgtaggtggacagctcggcgttgagcttgtcgcccacgtcgaacacgacgcccagcatcgatacggacacggtcgccgacaggcatacggtcagcgcgataagcaggcgccggcgcagctgtcgggtgaacgagcgagtaatcatgcgcagaaagaacatgattcttgtctcctgcctgactcaccggaagtgggcgctcagcgcgtccagatccgtagtttgaatggtgatcttgccatggccggtcttgtacgggaatggtatcggattgcagccacccttgaagccgatggtcgccaggttgatggccacctcgcacttcttgcagatgatcttgccgtccttctcgtagtagccagcgtcgccgcagttctcgcaggcgtccaggccgatgccgtacgcgccaccgttctttcggatgatgatgaagcgcatgacggtgccgtccttggccttgtattcgaagcggtgcaggtggccgtcctcgacctggctgaaggggatggtggccacgccgtccttgagcgagtaggcttccggcggcgaaagggtgatggtctgatgggtcgcggcaacgcccacggtcagggttgctgtgacgccgatggctgcgataaggctccacacggcagcggcgatggcgtggcggcggaataccttatgccggcgcaacgtggcctcgttggctcccggcacatcatgggttttcatacggaaaccggccacgatggaggccacggcgggaatcaggaacaccagcgcctgcgccataatcatcgtggagttctggttgatggaccaagccagcgccacgaacatcgtatggttcatcgggaagcctcgcgcctgcagaatctgggcaagaccagtgaagtgttgaatcagcagaatcaccatcatggccgcgacggccacggtgaacgcccagcgcacggcagtggtgcgcatcgtgcggaagatggcggccacaataatggacatggccacgccaagcaggaaaccaagagcgcgcagcagcatggccgaagtgaatgcggtctcccctggttccacccagatggtgagctgcagaatcacgtccggcagcgcgtagaacagggtgagtgcgatgtcgatggcggccacggcgttagcgatgtgcatgaacaccttgtgctgctgccaattggtggtgatgcggcgtgcgaacaccaccacgacgatggtcaggatgtcggcaatgatcgcgcaccacaacaccgggtagttgacgaacgtgcgctgattgatcacggccgaggcgcgcaggccggcgaatacgatggcggcgatcagaccgacgatcaggccgatgagacgccaatgcgagcttatcggcttatctcgcccctcgccgaccgtgagcatcacgctcaggctcatcaccagcaatgcgggggccaaagtgcccggcatcactgccacgaattgttcaagcattcgcgtcctttctctgttcaccttaggctcccctctctgaggggagctgtccgcgaagcggactgaggggagttttagaccgtcctaagaattatctccctaaagcggcgtaaagccccctctgacgagggggctttctgcttagtcaatcaccactggcgaggagtgtaatcccagttgtcgaaggtgacctcgatcggctcggtccagaagtggcccttgacgccggtctccgggtcaacgtgcagcatccaacccttggaggccggggattcgatggagagcttcagctggtaggtgccagccttgtcgagcttgacgttggcgccgtagtgcgggccatcggaagcgttcatctgcatgaaggtaccggaggtggcggtgccgccctcgacttccttgccggtggacttatcgatgatggtgtagttcacggtcagatccggcacgaagtcgcccttgccgtagccgagctcggtgcccttctggttggcatggatgtcggcctcgaggtggaaggaagcgtcagcagccttcaggcccatggaagacggctccatatcgatcggctggaagtacacagcgcccacggtcagcgggccggcgtcctgatcctgctcttcagcagtaccggacgggccaaccggaacctcttcgaaaccggcgccggaatcggaggaagaatcggaggaagaggagtcggaagactgggaggaggagtcagccttagtgtcggatgcggagttggtggaaccgcaggcagccatggacacggtcatggaaccggcgagcagcaggccgagcagagcggccagtttcttgttcttcatcattgttattccttttctctatctctggtgaattaggattcacgcttagataattgcaattattcagttatgagataagtgcggcgtgggctggaggaattggcatcgatccgaggccgtgccgcaagtctgtcagttgtctgcagttatgggaggaaacggacgagctagacgggctacgccttcacggccgggacctcggcagtagcctgcgccttcagcttgcgctgcttgatgaagccgaccacgaacagcgcgataaccgcaacggctgcgatggcctgcgccactaggcattcgacgtacgggtagaggccaagccaatcgttcgtcggcacaccgttcaggtagaaggcgggcagcaagtcgccctcgatcagcgagtggacgccgccgccggcgaacaccaccaccagcacagacatcagaatcgaagtgaccaggaagaacggaccaatcggaatcttcacggaggtgaagcggaagagcaggaagatgccgacaagcaccaccgcggcggtcagaccaccgatccacataccgcgagtatcgcggctcatcgtgtagatggactcgtagaagatcacggtttcagcgccttcacggaacacggcgaggaagctcagcatagccagcgagaccacggttttcaacgtcacgttgtcggcacttgcggcggcttcggcatcagccacagcagcctcggtcttcttgcgaatgtaacggttccacgcttccacgctggacttgttcagcatccagttactcgtccacagcagcatgcccatggcgatcagtgcgcaggtgccttccatgatctcctgaatcgggccggagccgccgaaggcgaacacgaagatcacagccaccaagccggcgccgagcagaccgacgagcacacccaagtaaatccacttgacgaagcgcttgttatcggacttgaccaagtaggcgacgatggctgcaaccaccagcagagcttcaagaccctcacggataagcacgaggaacgcctggccggaggagctggtgaccagcttggtgaaaccgtcttccttatcggcggcaccaccgtcaagaatgccggcgtccttgatcagcatggccttgaggtcgtcgatcagcttcttggtgtctttcagggatgcgccggcgttcatggacttgcggcacatcttgaactggtattccacctgcgagacgcggttgccgctgatggcgttcatcacgttcttttcgaagccgagcttctcgtaatactggtagtacgcgttgttcacgagcgtggcgcccttggcaccatcacccttttcgtaagctttgtatgcattgtcgagaatcggggtcatttcgttggccacgtcggtccatgaacgattgcccttgcccgggttcttctttttcttggcgtcgagctccttgcgctctttggccagctgcgcctgcagcgcttcggcgtacgccttcggcttggcgagatcggcgttggtgtcgagctgctgggccgtggcgtcaagatcggcggtcaacgcatcaatctgctgagccagttgatcgtcgttgctaggcgtgtaggaaagattctgaacgctttggaatgcctgctgttgggcgagctgcttgtccgcgccaatggtgtcgtgcacgaccgcggtgaagttggaggccacgtaaatcttgttgtacgcgcccatgaaatcggaggtggcgccagcggtgttgccatccttgtacgtcttaagaccgctgttcagctgcttgtccatcgccttggagacttcggcccaggtggcgtagtcaacgctggacgagcttgatgaactggacgagctggtgctgctgtcggcgaaggccatcggagccgtgactgcaggagccacagtggcgatgaccatggcgaacagaaatacaatcgcagccagaactcgcagctgcctcacgctggtgtgttcaacggaccgaagagcagcctgggcgcgacgaaccatgcctatccctctctctgcgcggctaagtaatcaaaaaccaactactcaatataaagaaaaacttttttgaggaacagtcttgattttttaggatttaagaggtattaggcactgtttttcgatcaattattaccgcagattgtctcaatattcgatattgtcccgctcacagatgggagacttcccgaattatgaactccccgcgactggccactccccatccctcatattgcatgaccaactgtttcaccaaggttcatagcctaaaatcactatgttgcatcacggcaagaggctggcaataattcacgcgatggcatgcgcatgttcattctggtttgcctcgggtttgctgacttgccttgagtcgctttgatttgcactggttcatcccccggtgagatcacctgttgcacacgccgtacgaacgacctgcacatcagcgcaggcactcattggtggtccttgtccacaaagcgacacgccgcagccggcactgaatgtgcatttatccgaaagctgtggtagcttattcgagttgcctacggagcttacttctagcaagcactgcagtgcatggaggattcgcctagtggtctatggcgcacgcttggaaagcgtgttggtgtaacagcctcacgagttcgaatctcgtatcctccgccatcagggttttggcttttgtcaaaacccttttgttatccgcacccacatgcatatacgcagcggtccaaatatgtgcacaatcgtgcacattcactgtttttgcagtggcgtggcatggcacatattccgagacgaccgaattcccacaattttcgtgccacaacagcgcataaaaacacgaaaatgcgattacgtggcacatccgaatgccacatgagcgcaaaatagccaatattgcgctcatgtgtacaacttagagcacccgaatacttcctcgcacacccgtcgatttgcgtaatacgcgattgcgtgtattgttgtgcaagccgttcaacggccctaagccgtgcgcacattatcgccccgatagctcagtggtagagcacttccttggtaaggaagaggtcgtgagtcaatcaaaacaagccgacccgaaaccagccgttgcacttacaagttgaatccggggccggcgacctcggctcccctccctgaggggagctggccgcgaagcggactgaggggaatacgacggcacccgtaactcccctcagcctcactgcgttcgacagctcccctcagagagggagccaaaaaggtctataacgaggctgcctcgatgagctgacgggtgtaatcggattgggggttgcctagcacttcagcggtgggacccgtctcttcgagacgcccgtcatggagcacgaggatgcggtcggcgatgtgctgcaccacgccgagatcgtgggagaccatgatgatggcggtgctcggccgggccgcgcggatggcggcgaaggtgtcgaggatctgaatgcgcgcggccacgtcgatggcgctcatcggctcatcggcgaggatcactttgggctcgttgatgatagcgcgggcgatgaccacgcgctgcgcctggccgccggacaggtcgattgggtaccggttcaggaagtctgccggttcaaggcctgccatggtcagagccgcggccactcgctcgtcgatatcggtgttgttcaggtcacgccgttgcagactcagcggttcagccactgatttggcgactcgccaacgtgggtcgagcgaggagaacgggtcctggaacaccagtcccgattcgcggcgcagggccgcgaatcccggcgattttcggccgccgacaatggattggctctcgtattccacgctgccggagtccgcggattccaagcccagcataatgcgggtcagcgtggatttgccggatccggagccgccgatcacggccagacattcgccggcgtggacgtcggcggagacgtcgaagaggacttggtggcgtgcggtgcgcgggccgaaggatttggtgatggagtgggcggagaggagcggcacactgctgttactcatgcgaatcctccttgggggtgtggagggtgagggtttgggcggcggcgaccaggcgctgggcttgtggtgtggtcggcgcggcgagcaggtcggcggtgggtccggattcgacgatgcggccggcgtccagcacgtagcagcgggtggtggcacgcgcgagtacggagaaatcgtgggtgatgaacagcatggaggcaccggcgtcgtccaccagcgaggtcagcaggtccacgatctggcgttgcgtgatggagtcgagtgcggtggtgggttcgtccgcgatgatgaatcgcggtgaggtgatcagcgccgtggcgatgcccacgcgctgctgttggccgccggacagttcgtgcgggtatttgccggccatatcgagatccagcccgaccttgctcaacaaggcattcactcggtcggctcgttcgaccttggtcagatcatagtgcaaccgcaatggcaaggcgatctgctgcgccacggtcatcaccgggttcagcgaggcagccggattctggaacaccgcacccacataccggccgcgcaggtcggcaagcgcacgttcggaagctccgataatttccgtgctgcccatatcaatcgacccattagtcacagcggtcaggggcagcaaccccagcatcgccttggcaatcatagattttccggagcctgaagaaccgatcaagccgactcgttcaccgtcggcaatggtcatatccgcatcagagacgattggtttgccgccaatcgtgattttcaacccgcgaacatcgacgctcatcgttcgcctcctatttcacgtaatgcggggttggtgaccggatcgatggcatcgcgcagcacatcaccaaaaatattcagcgccacaaccacaaccgtgacgatcaggccgggccacaccacggttaatgggaacacgttgatgagtttgaccgaagtggccagagaatgcccccagctcggcacaccggacggcacaccgataccgagataagtaagccccgactcagccaacaccgccgtgcccgccgacaatgacagttgcacagccaataccggcagaatattcggcataacatggcttatgagcacacgccacccgctggcaccattggccaaggccgattccacatacgacgagcgggccgccagcaacgctgcggggcgagccacacgagccagattcaacccatatccgaagccgcaggcgatcacaatcaccgcgattgacgctcccaacggcacagccagaatcaacgcaatcaacacggtgggaacggaaatcaacgcatcaactaccactaccgaagaactggcgagcgccgcattgcgtgccaccatggccgcgatgagcagcagcccccaagccatagatgccactacggtcagcagcacgatcacaagattggtatgtgagccggccagcagccagctgaacacgtccgcgccggtgccgtcagtgccgagccagtgctcggcggacggcttggcccatacatggtagccatcagtggcccacagcgattgcggggtccagaacagggaaacgatggcaatgagcaaccacagagcgagcacgataagtgcgaatttgccctcggcacgacgccacatagagtgcaggacgatgacgaaggcagcccgtcgaccaccagtcgtcgcacgacgaacattgctcatgcggtcacctccgtaatggcggtagcggttttcagacgcgggtcgagcacgcggtggaacaaatcgaccacgaggccgacagtcaaaaagaacgcggccagcaggaacagctcgctttgcacggcaatcaggtcgcggttgcccacgtcggtcacaagaccgttgccgatgcccggtaacgcaaacaggttttcgatgaccatcacgccagtgaccatcgaagcgaaggtcagcccgataacagacaccagctgcggggttgccaaccgcaatcccacacgcaacaccgcctgagtgcgcgtcatgccacacgagcgtgccatatcgatgtagccggaactggctaaatcccctaaggccgcgcgcgtgtatcgcataagcgatgctcccacgatgatgccgaccgatacagccggcaataccaacgctgatatcgccgaaccgggtgcgccccaaccatccagcgggaacccttgcgagggaaacacatcaagcaatcctacgccgcgcccgaacaacagaatcagcagcagaccgccccacaacgcaggtacggcaccgccgacaatagccagtacatgaaacaccgcacgcaccgttgcgctgcgggccagtaccgccgcacagcccagcggcaagccgatggccaaggcgatgagcaggccaagaataatcaggggaaaggtgatggacgcacgtgcgcctaccaaggaggttacggagcgaccagtcaggattgaagtgccgaagtcaccacgggccagcgcactcatccaatcgaagtattgtgcaatcaatggccgattcagaccgagttgttcgcgtagctgggtcacacgctcaggcggcgagttgacgccggccatcacggaggccacatcgccaggcagaatgcgcaatgctgcgaaaaccaccacggacaggccgaacaacgccaccacgaataacgccagccgtttcaacacgaatcgcataatgcctactttacttggattaacaatgagccccctcactgagggagctcattgctgtaacgaactacttcgtgtaggtcacgttgtagaggggcagaacggtctggttgaggtcgaaggggaatccttcaacgcccttggccgtggcggtggtgatgcggtagttgaacagccagtcggccggcgcatcctcggagacaagcttggcggccgcggcgaacttggcatcacgctccttgtcggaggtggcggcaacaccctcgttgtacagcttggtcacattcttgttgtcgtaaccgaaatagtatgtcggatcggtccacgatgcgaagtcgtggctttcgttgtggtccaccagcgaaatatcgaaggtgtggttggtgtacacatcctgcagccacgtggagaactccaccacattcaccttcaggtcgatgccgatgggcttgagctgggagcgcagctggtctccgagctcggtgccgtagatgttggcgtaggtcagcgtaagttgaagcggcttgtcggtggaatagccggcttcagccatgagcgacttggccttgttctgatcatacgggtacagattcgtcagatcctcgtagccggggtcgagagacgggatcgggccgccgagcgccttgtccgcaccgccgcgagaggcgatgagctccttgtggttgatggcgtaacggatggcctggcgaatgcgcttgtcagccagtttggaaccggaagcgttgttgaagccgagcacgaacttgtcggtgccgttgccggctttgaccgtgtacttggcggaatcggacttgaacggttcggcgaggttctcggtaatcggggcgagcacctgcacgtcaccggacttcagcgcattgaccgcggcgttgtcgtcggccagatacttgacgaccacggtgggcgtcttggccttgttcttgccccagtacttctcattggccttcagcgtgatcgagctgttttccacgaacttggcaacggtgtaggggccggagccgacggcctgcgtcttcaggtcatacttggcgtccttgtcgaacacgagccctgcgcgaccggtcagggtccacaacaggttggagttcggcgtcttgagcgtgatcaccgcggtgtcggcgtccttggcctccaccttgctgacggcggcgagcgcgtcggcgtcgtggtagcccttagcgatcagctcgttgatggaccaggccacgtcctcggcgtcaagtttgtcgccattgaagaaggtcatgttcttattgaggtggaaggtgtaggtcaggccgtccttggacgtctcccagctggaggcgatggcgggagcgacctggttcttggagtcacgtgccacgatgccttcgtatacgttgccgatcaggatctggtcaagcgcggagccggcggtgttgcggatgtccagattggtgggggccagtttgaggccgatggtcacggtgtcggcatattggttgctggacgaagccgacttgtcatctttcttaccgccgaaagcgagcgtgacgccgatgacgaccgccactgccacgatgacggcaatcagtgagatcagccaccacttcgggccgctttttttcggattctttgcgcgcgaggcaaggctcgcatctgtggttgcgccgtcttcgacgtgcgcaccattgtcttgagacatggttcttcctctgtatatgttgtgttctacggttggccgccacgctgggtcgaccaccgcaggccatcatagccatgggactgtagaattgcgcatgaaatccatcttgaatctggagggttatcatgctggtcgccgttgatatcggcaatacgaacatcgtgctgggctttttggatggcgatgccatcgccggcacctaccgcatcaccaccaaagccaaccatacgtctgatgagtatgggctgtttctgactgaattcctgagaatgagcggttttcagccatccgatgtggacgatgtgatcatctgttcggtggtgccgaaagtgatgcactccttccgttcgtccatcgtcaaattcctcgacattgatccgatggtggtgggaccgggcatcaagaccggtatgaacgtgcgcgttgacgatccgaaatcgctgggtgcggatattctggccgactgcgccggtgcctattacgagtatggcggcccagtgctggtggctgatttcggcaccgccaccacgttcacgcacgtgagcgacaagggcgtggtcgattccggcgtcatcaccaccggcatccgtgccggtgcggccgctctgtggggagatacggcccagctgccggaagtggaaattacgcgaccggatacgattctgggcaccaacaccaagacctgcatgcaggccggtttgtattacacgttcttgggcggtgtggagcgcacgattcgtcagttccgcagagagctcggaggcgaggatttcaaggtgatcaccaccggtggcctcggtcgagtgtttgagaatgacaccgagctgattgacgtgtatgacccggatttgattttcaagggcatggcgcacatctactcgcgcaatgtgaagtgacgtagtatgcaggaatcggccgcgtatagcgcggtcgattccgacccaaccccgaatccctacttaatcgtaaagccctgattgaagccgtattctcggaggtctttctgccattgggccaggccgtcggagagactgactttcttgccgggcttctccaacggttcgagcgggttgccttcctcgtccttcatgcccatctcaatggcttcctgtcgctgctgataggcgtggaaactgccggaccactcgtatgcctggcccaccgtcgatttgaagtcactgcgcgcatacacttcgaatggcagatactggtatccgaccgacacatcctcggcggcctccgacagtacccggttgaacttctgcccgccgaaatacgggatttcaatgccacggtcattggtaatcgtggttttatccagaaaatcagcggaattcagggtggcgtaatcggccggaaaggcaccgccgtctacacgcgcgctaatgccttgggcgtcatgcgccacaaagtccacgaaacgataggccgcatccggcttacgggtcaattgcagtacggtcagtgccgacccgccgctttcggcgttggtgggctggccatcataggtgggcatgggagccacgcgccacagaccggccgcgcccggcacattggacagcagcagcgacggcatccaggccccagagaacacggaggcgatggtaccggtgcccacacggcgcttccatcggtcggaccatgtggcggaggtggtgtcaacaagcccctcatcgatcattttctgccagaattcggtgaaccgttgggtgccggcgtcctcatccaaatcgatggtcacggttttgccgtcggccgacgtgtggaacggctggccgccggcgagccagaccatggcatcgtaaaagctgccatcgcccgagtcggcggcgatgtacacgccaatctccttgagctttttggcagcctcatagtagtcatcccaagtcttgatcttggtggcgtccacgccggcttggcggaacacgtcttcgttgtagaagaagcccatcgggcccgaatccatgggcagcccgtaggtacggccggcgagctgcacggacgaccatgtgccgagggtaaagaagttggaataatccgagccgattttgtcggtcagatcaagcaattggccggagaccgcgtactgcaacagtgcatagtattcgatttgagccacgtccggcgtgccgtaaccgtcctgaatggcggtgttgagattgccatagccggagatgttggtccatttcacgcggatgtccggattggctttttcgaaacggcggatgacctcgcccatgctcggttcccagctccatacgctgatttccgtgcggttatcggtggtggactgcccgcacgaggccaaggatacggaaaggatggcagtcactgctatggttgccattcttttgattcgctgtccgatcactcgcatggtgacgagtgtactaggcggggcttaaaacggtaaaagccccgtgacgggattcgtcacggggctttgtgtatcaggtgagattagctaggcagtctcagcgagggttcaaggcttacttcacggtgaagccctgatccttgccgtaatcctgcagtgccttctgccaagcggcgataccgtcagtcagcttctggtcgccggtgtaggacttgccaaggtagtcgccgaagatggtgcgggccttgacctcgtagggcaggaactggtagtcggaggacacgttctcagcagcctgagccagaacctcgttgtacttctgaccaccgaagtagtcaacgtcctcgccatcggcgttcttcacagtggtggtgttcttgaaggagtcggactccatggaggccttgtcagccgggaatgcaccgccggccacacgggtggccacgccgtcgccgtggttggcgtactcgatgaactggtaagcagcgtcagccttcttggtggaggcgagcacagccagcgaagaaccaccgttctcggagttggtggtggagccgtcagcggtcggcatctgggtcacacgccacttgccagcgccgtcagcagcggagttggccaggttggcaggcatccaagcgccagtgaacagggaggcgatggtgccgtcgaccatgcccttgaaccagtcctcagaccagccagcggtcttggtgtcgagcaggccctcgtccagcagcttctgccagaagtcggtgaaggtcttgacgcccttgtcctcggtcaggttgacggtgacttcggaaccatcggaagaggtctggaacggctttgcaccggccagccaggtcatggagtcgaagaagccggcgtcaccggtgtcggaggtgatgtagtagttgtcgcccagagcgtgaatcttcttggcggcgtcgtagtactgatcccaggtcttgatctgctcggcgtcaacaccggccttgtcgaagacctccttgttgtagaagaaggccattgggccggaatccatcggcaggccgtagaccttgccggcgaactgcacggaagcccacgggccaggggtgtagaagtcggagtagccggaggtcttgtcggtgatgtccagcaggttgcccttgatggcgtactgcgggatggcgtagtactcaacctgagcgacgtccggagcaccggagccagcctcgatggcgttatcaagctgggtgtattccttggtgttggtgccgacgttcttgagatcgaccttgatgccggtcttcttggtgaagtccttggcaacctgggtcagcgtgggctcccaagcccacacggtgatttcggtaacgtccttatcttgagccggcttgccactggcggtgtcggaaccgcaggcggcaacggaacccagcatggcaaccgcaccggtaagtgcaatggccttcttagcaacggtgaacttcatcgttctgttctccttccttggatcgcctttcggcggtctgcagtgattgtcaccacaacagcatggcaactctcctcgtcgtcatgctatcgtgaaccatcactctatggttcagtagtcacaaaacggctttgtttcgccactttgtagctatggttgcgataacatcttttattatacacattcttcggcaacacgccatcttggtatcgcaatccgcgcgccactgctcccatggcataagaaaatcgggcgctccgaagagtgcccgatcctgttatcgcaacctcccgctacagaaaccacaggaggaagtctgctgtgattgccgttacttcacctggtagccctgctgcttggcgtaatcctgcaggtccttctgccaggaagccacggcatcggagagcgtggtcttgccggtgtaggcatcgccggcgtagtcgccgaacttgccgcgagcgtagacctcgaaaggcaggaacttgtagccggtggacacattggctgcggccttggccagctcctcgttgaacttctgcccgccgaagtactcgtgggccttgccgtcggagtcggtcagggaggtcatgttgaggaagtcgtcggacttgagggtgtcgttgtcggccgggaaggcgccgccgtcaacacgggtcttgatgccctcggcgtcgtggcaggcgtattccatgaacttgtaggcggcggcgaccttgtccttgtcgtcagacttcacgatggccagcgaggaaccaccgttctcggagttggtctcggagccgtctgcggtcggcatctgggcgatgcgccacttgccgtcaccgttcggagcgccggaaagcaggttgtacggcatccaagcgccggtcagcagggatgcgatggagccgtcatccagacccttgttccaatcgtcggtccagccgacggtcttggtgtcgatgagatcttcgtcgatcatcttctgccagaagtcggtgaaggtcttgacgttcttgtcaccggtcaggttgatggtcacggtcccgccgtccttggaggtctcgaacggggtcgcgccggccagccaggtcatggagtcgaagaagccggcgtcaccggaatcggaggtgatgtaggagtccacggcgcgaatcttcttggcggcctcgtagaagtcgtcccacgtgcgcacctgagtcggatcgacgccggccttgtcgaagacgcccttgttgtagaaccaggccatcgggccggaatccatcggcagggcgtagacgccgtcattgatgttcaccgaggaccacgtgcccggggtgtagaagtccttgaaatcggaggcaccgagatcggaaaggttctcgaggtggccgcgaatcacgtattcgggcagtgcgtagtattcgatctgggcgatgtccggagcaccggagcctgcctcgatggcgttggacagtgcgttgtactcgtccttgttggtgccggcgttggtcaccttcaccttaatgttcgggttcttggcctcgaatcccttgaccgtacgaggcagtgtggaatcccaggaccacacggtcagctcgaccttcttatcagaggagccggtgcttccgccatccccggcagaagtggaaccgcaggcagctacagaggagagcatggccacagcaccaatcagggcaatcgtcttcttgccgaacttcatcgttctttccttccttgttatgggaaacgacgggacttggcgttttgttccaagccttgtatcgttttaagaaacggtaccacatgttttatgtttacgcaaacacgacacgtcgcaccatggtgactaaccgcaaaccgaaggagatgcatcccgctcatgaccactcacaacagccagtattccgccgaaaccacccatcccgacaagcaggaaagcagcccggcgccgaccgccgccggcaccacggccagtaacgtctccacaactggcaacgcaaccacgccggacgccagcatcgccctcaacgccgacgccactccggtagccgacgttcccccgcgtctgttcggctcattcgtagaacatctgggccgctgcgtctacggcggcatctacgagcccagccatcccaccgccgacgaaaacggcttccgccaagacgtgcttgacctggtcaaggagctgggcgtcacctgcgtgcgctaccccggcggcaatttcgtatccaactacaactgggaagacggcatcggtccacgcgagaatcgccccatgcgccgcgacctggcctggcattgcaccgaaaccaacgagatgggcatcgacgacttctaccgctggagccagaaagccggcaccgaaatcatgcttgccgtcaacatgggcacccgggggctgaaagccgcgctcgacgagctcgagtatgtcaacggcgcgcccggcaccgcttgggcggatcagcgcgtggccaacggcatcgaggagccgatggatatcaagatgtggtgcatcggcaacgaaatggacggcccgtggcaggtgggccacatgagcccggaagaatatgccggcgcggtggataaggtggcccacgccatgaagctcgccgagtccggtctcgaactcgtggcctgcggttcctcgggtgcctatatgccgaccttcggcacgtgggagaagaccgtgctcaccaaggcttacgagaatctcgacttcgtctcctgccatgcctactacttcgaccgcggccataaaacccggaccgccgcctccatgcaggacttcctggcctcttccgaagacatgaccaagttcatcgccaccgtctcggacgcggccgatcaggcgcgagaagccaacaacggcaccaaagacatcgccctgtccttcgacgaatggggcgtatggtattcggacaagtggaacgagcaggaagaccagtggaaggcggaggccgcgcagggtttgcaccacgagccatggcctaagtctccgcatttgctggaagacatctacaccgcggccgacgcggtggtcgaaggttccctgatgatcaccctgctcaagcactgcgatcgcgtgcgttccgcctcgcgcgcccagctggtcaacgtcatcgcccccatcatggccgaggaacatggcccggcatggcggcagaccacgttctacccgttcgccgaagccgcccttcacgcgcgcggccaggcctacgctccggccatcagctcccccaccatccataccgaggcatacggcgacgtgccggccatcgacgcggtagtcacgtgggatgaacaggcccgcaccggtctgctgcttgccgtcaaccgcgacgccaacaccccgcacacgctcaccatcgacctttccgggctgcccggcctgcccggtctcggcacgctcgcgctcagcaaggcgcaactgttgcatgaggacgatccgtaccgcaccaacaccgccgaagcgcccgaagccgtcacgccgcaaccgctcgacattgcaatgaacgccaccggcacctgcacggcaacgcttcccgccatctcctggatcagcgtggaattccacggctaaaagacggagagtcacgcccgtaccaagtacagtcaagtccaatacgaccagggcccgtcaatcaccatacgattgacgggccttgtcattcacttcggatatttcgaaccacggattcatcaggcgcgcgccaacgccggtgaggactcgcgcagggagaggctatagggggcctcgatggtttgggcgggggcacggctgccggattcgacctgttggatgatggattcgacggccagtcgggcgatggcttccctgccggagttaacggtggaaagagacggcaccatgtaggccgattcctccacgtcatcgaagccgataacgcgaacatcatccggcacggcaacgccgcgttcgcgcagttcacgcagcacgccccacgccagcaagtcattcaaagcgaacacggcatcgaattgcaggccactctccagcatggtgtccaccgcgaccaaaccgtcggcgctcccccagccttgggtttcgataagcagactgtcatcacaggggatgccgcgcgcggccagcgcctcacgatatccgtgggtgcggatggagcccgacgagaaatcgtgctcggggtggggcacggcaccgactacggcgatgcggcggcaacaggcatcaagcaggtgataagtcgcggcggcggccccttcgcgattgcgaatcactacgtgcggcgcgttgacgccgaacaaacgttcacccaacagtacgagcgggtaatcgccatccaaagccgcgatatcgtcaaccgtcatcatcagagggcttaagatgagcccgtccgcgctgtgcgtgcccatcgatgcgatgctttccagctcgcgggcacgattgttagtggtggattccacgatgacgccgtagccatgttgccgggcctcggccagaatatcctcggcgagttcggagaagtacacctgccgcagatcgggaataaccagcttgagcaaccgggtacgcccggaacgcaggtttctggccgacgagttgactttgtatccgagcctgtcgatggcttccgcaatacgcgcggccatcgcctcgctcatatatggctgtttgttcagaaaattagacaccgaggctaccgaaacaccggcctcatgggccacgtccgccatcgtcactctgtttttgcctcgcacggtgaccaccctacccgactttgctggagatacgaaaacgactcccctgctacgatgagcagcaagggagccgttgggtaattaggcgctatgcgcggttttacagcttgacgacgagtacgccgttgggctggatggcggccgtgcgctcggactcgttgacctgggccagcgaggcgaccagcggttcgccttccacgtccacgaccgcaacatcgtgggtgcggttgaacaggaacacgaagtggttctcgccagtttcgtccgcacgctcgacgcgcagcacttcaccgcgatcgtcctcagccgaagtctcgatgccgagttcctccagcagcacgggcaggctcttggccaaaccctcacggccgagacgggcaccgacgtatgcggccttgccgtcgccgaagtcgttgacggtgatggcgggagcgccgtcgaaaccggtccacttatctgccttgaaggaggcaaccacgtgagcggtatcggccacggaggtgatcacgtcggcgaaatcgtgcgccacggttccgttgtccaagtcaaggtggtccatggcaccggggaagtcgttgcccatcggggcgaattcctcaacgcgcacacccaccacgtcacggatggaaccggggtagccacccagccagacgtgatccttgtcgtccaccagaccggtgtagtaggtcacgaacagcttgccgccgttcgccacatactcgcgcacgcggcgcgtggtctcttcggacaggatggtcaggctcggcagcacgacggcttcgtactcgtcccaagggccgcgaaccggcaccacgtctgcggtcagaccgttgtccgccagcgcgcggaaccacgcgagcggctcggtccaatggcgtacctcctgagtaggcgtggcggtgtgttccgtagcccactgggactcgtaatcgaagacgacggcgaccttggacttgaccagcttggtgctcagcaggccctcgtcagcaagcttgttgaggtcggcacccagctcgcacacatcgcggaagatctgggagtcggggcccgcgtgaggaaccatcgaagagtgccacttctcggcaccggccttggactggcgccactggaagtagcagatggcgtcggagcccatggccaagtgggccagggagtcgcgcaccaattcgccgggctcgacgcgatagttgatcgggcgccaattgacggcggagctggagtgctccatgaggaaccacggattcttgcgggcgatgccgtcacatagggaggccgagtaagccagctcgtcgaagtgagcttcgccaggcgtgaagtagtgatcgttggacacgaagtccacgtcgtaaccccacttgtcgtaatcgatgccggcaccgccggcggagaccatgaagttggtggtctgcggcttgggggcgatctcgagcagggcgtcgcgctcggccttgtaaaagtcgagcagggcgtcggagctgaagcgcttccagtcaagcagtttgcccggattcatgaagttgccatcgccgatgaagcgcggcgggatgatctcggagaaattgttcatgcgctgcgcccagaaggcggtgccccaggcgtcgttgacagcgtcgatggtgccgtacttcttctcgcaccacttctggaaggcgcgctcggcgtcttcggaatagtcgaagcggttgtggcagccgtactcgttgctcacatgccaagagaccacataggggttgtccttgtagtgctcggccatcttgcggcacaggttgagcgcgtagtcaaggaagaccgggctggtggcgcgccagtgctggcgggcaccgggctggcagacgtcgccgcggtagtcgacccagaggatctccgggtgggcctgggtcatccacatcggcggggatgcggtgccggaggcgagatcgacggcgatgccggccttgccgagcttgtcgatgacgcgatcgagccaatcgaagtcgtacacgccttcttcgggctcaagcttggcccaggagaagatggctacggagacgaggttgacgccggcctgctgcatgagggctacatcttcgtcccacacttcctcaggccattggtcggggttgtaatcgccgccgtaccagatgcggggcttgttgcccgcaagcggctgcggccacttgaactctttacgttccatgatgattcagctcctttattgaattttatcgataatctgcgtccgcgggaataaacagcccacagggctgtttgcctaacggctcagctcgtcagagaggggcttggcactattacctccctctgatgaggaaggttgtctcggcggagccgggacggagggagagaccccgccgcgaggcggtgaagacaccgcgtcggcggagccgactccatcactccttgacggcgcctgcggcgagtccggactgccagtacttctgcaggcacaggaacgcgatcaccagggggatgatcgtgatcagggagcccgtgatcaccaggttctggatcgcctggccgcccgcggtcgaggcctggtccttccactggttcaggccgatggtcagcgggtaccagtccgcgtccttgagcatgatcaacggcaggaagtagttgttccacgtcgccacgatcgtgaacagggccgtcgtaacgatgcccggagccaacaggggcaaggaaatctgccagaacgtgcggaactcggacgcgccgtccacgcgcgccgcctccagcagctcctggggcacggcctgctcgctgaagatccacatcaggtacaaaccgaacgggctgatcagcgacgggatgatcatggcccacggggtgttcgtcaggcccaatttggcgaacaggaggaactggggaaccgccaaagcgatgcccggcacgctgatcgcgccgatgatgaccgcgaacaccgctttgcgccccgggaagcggaacttggccagagcgtagccgcccatgatggccagcagtgtcgcgccgccggcgccgaccaccacgtacaggagcgtgttgagcagccagcgcccgaagataccgtcctgataggagaacaccgtcgcgatgttgtcgaacagggcgaacgtcttgccgaagcccaggccgaacgtactggtgaagtcggcctgcgtcttcgtcgcgttgatcaaaaggtagacgaacgggaacaggcagtacacggcgaagaccgcgcacaggacggtcaacaacgtggaacgcctcgggttgttcacgttcgcgaaccccgccttcgcgctgcgcctgcgttcggcggcctcgtcggcggcgatcctcttctggcgggccttctccgccttcctggcggccttctcccgggccttgagctcgccgtcggtcaggcgaccggcggccgaagtcgttgctgcactcatcacatacgctccttcacgatcatcatcgattcctcaacacgaacagcagtagtcgtcgtcacttcatctgctccttgaggctgttgagctggacgatgtaggcgatggccatggtgatcacggccatcacgatcgccaacgcggccgcgtagttcgactggttgccggagaagctcaggttgtacgcgtacatgttcggcgtgtaatacgtcgtgatcgcattaccaggaaccatgttctgcaaaatgctcggctcgttgaacagctggaacgagccgatgatgctgaagatcaccgtgatcgccaggctgccgcgcaattcgggaagcttgatgctcttcacgatctgccactccgacgcgccgtcgatgctggccgcctcgtacagggaatgcgggatggtcgacagcgagctgtagaagatgagcatgttgtagcccgtgaactcccacgtcacgatgttcccgatactggccaacaacacgctgggggcgagcacgtcgatgtccgtgcccaggaaatcgttcaacgaacccaccaggccgtacttcgcgccatacacgaaaccccagatcaacgtcgacaccaccgccggcaccgcgtagggcaggaacgtcgagatacggaagaacctcgtgccatgcagcttcatcgaatccaacgccagggccatcaaagccgacaggcacagcatgatcggcacctgcacgcacgtgaacagggccacacgaccaacactgctccagaactggccatcacccaacaggcgcgcgtagttctcgaagccgacgaacttggtgccgccgatcatctgcttcttgaagaacgaaatataaacggcgtacacaatcggcacgatgaacacgaacacgaacaccaccgcaaaaggccacatgaatttccatccacgccaatcggccttgtgcttattcacacgagccttgcccgaatgcacgggcgcagctgcgatatcggctgaagccattcccaacccctctccttcgaaggttgaccaaaatgtttgcgttatcatcataacaccatttgtaacattgtccaatcgtgttgagtaccgtgttgaattaagggtttctcagtcactctgctacaatggtcacgaagacaacgatgttatcgttaccgtaagcggccctaagataagcgttgcaaacgaaacaccgacattaatgagtcaagcgagggtgaaatgtcgaggccaacacaggtgtccatgcaagacatagcgaaagccgccggcgtttcgccacagacagtgtcccgcgtggcgaatggcagcgatgcggtgaaacccgaaacacgccagcgtgtcgaagctgcaatggaacgccttgggtatcgtccgaattatgcggcccgagccctaaagcacggccgcttccaggatatcggcgtggtgatgttcaacaccgccacgttcggcaacgcccgcatccttgattctattgtggccaacgcggccgatgacgattattcagtcaccatccagaccatgcgccacggtgcggaacgcacgctttccgccgccatcgatcgcatgcagcgtcagccggtggatggtgtcatcgtagtgctggaggaacgcatctccgatttcgtcggatacaagcctccgcgagaatttccagtcgtgctcatctgcgaatccgccgccgaccactgccccaccgttgacgccgaccagtatggctgctcgaccgctatcgtcgattacctgatgagcaaggggcacaagaccgtctaccacattgccggaccgtccacctcgcgcgccgccgaaagccgcgcccgcggttggcgagaagcgttggaacaaatgggagcacgcgtaccgagcatgtacatcggcgattggtgcgcggattcaggctaccaggccggcgtggcgttggcccacgaccccgactgcacggccatctacgccgccaacgaccaaatggcatacggcgcaatgctcgggttgcagtcagcgggcaagcgcgtgcccgaggatgtcagcatcgtgggcgtcgatgattcgctggtagatatggttccgcgcttgaacctgacgaccatgaagctgcgctttgacgacattggcgccaccgccttctccatggtccgccgtcaatgcgaaggcgagaagataccggtcggcgtcaaaaccgtaatcccgccggaactgatcgaacgcggttccgtgcgcgacatcagctgacgagcggcatgtgctggcatccactggtacctgccagtgatccacctgccagtgattcataggcaacgccagggcattagtcagaccgacatggcccaacggctgggcgtgtcacgtcgctggctgatcgaatttgaacacgcccgagtccccaatcccgaattctccaccattctcagcgccctgactgagcttggcttgtcgctggatgtccgcaaaaccccgcagcccgccgaactctatgaatggtgacaccatgagcgaaaacactctcaatgcataagaaatcagatcttaagcggcacacgggaaacgaattcgcgcttctcgcctgttattggatcggtgaatcgcagcatgcgtgctaccaactgcaatggttggctgaaatcgtcgtaggggcgcgtctggatgcgcgggtagaagtcgtcgcccacgatgggcaggccgagcgaattcatgtggacgcgcaattggtgggttttgccggtgcgcgggtggagtgtgtagcggcagatggggtgattccccggatggggaccaccctccggcgcttcgcgccacctcccgtcagcgggagggaaacagaggtcgccgcgctcgatgagggtttcggcgttggccaaacccggttcctcgaatgcggccatcgtgccgtgttccttggtgatgtgcgatcggcgcagcaatgggaacgggcgtggcggctcgacctgcatgatcgtgccgaatcgcgggcggctgatcggccggcagggcgccaggcattcatagaccttgacggtctgccggttctggaacagcatctgatacgcgccgcggcaggccggatcccgcacgaacaccaatacgccggcggtcatgcggtccaatcggtgcgctggcgtgatgtccggctcccccagccgctcacgcaatcggatcagcgcggtctgccgataccacatgccgcgcggcatggtggccagaaaatgcggcttgtccaccacgatgatccgctcgtcctcatacagcacgtccatctcaaacggaatatgaggctcgtcaatcacataccgatgtggcttactcaacggtcacggacttggcgaggttgcggggcttgtccacgtcgtagcccttgagctttgccatgtccatggcgaacagctgcagcggcaccacgtcaaccagcgggctcatcagcgttgggcaggcggggcgccagaacaccacgtcagcgtaccgttccacatccgggtcgccctgctcggccacggcgatgatgtacgcgccacgagccttgacctcctcgataccagagatcaccttggcgtgcaacacattgcggccgcgctgcggcggcacgatgaacaccacgggctcaccctcgtccaccagcgcgatcggtccatgcttgagctcgccggccgcgaagccctcggtgaacgtgtaggcgatttccttgagcttcaacgcgccctcaagcgccaccgggtagcccacgtggcggccgaggaacaagaaggagttggcgttcaccatgcgctcggcggccgcctggatggtcttgggctgggtgtcgagcacccactgaatcttgcgcggcatgtctttcagggagtcgagcatctgatgaatctcatcgcggaacatcgcgcccttgacctgcgccagatacaggcccagcaggtaggcggcggtaatctgcgccacgaacgccttggtggatgccacggcaacttccgggccggcgtgtgtgtagagcacggcgtcggattcgcgcggaatggaggcaccctgcgtgttgcagatggccagcaccttggacccctgttcgcgcgcgtggcgcagggccatcagcgtatccatggtttcgccggactgagaaatggccaccacgagcgtacgcggggtcagaatcgggtcacggtaacggaattcgtgcgcgagttcgatttccacggggatacgcacccagtgttcgatggcgtatttggctacctggccggcgtagctggcggtgccacaggccacgacgatgattttgtcgatggccttgaagtcgtgttcgtcgatacgcacttcatcaagggtgatggcgccattcgtgtcgaagcggccaagcagggtgcgctgcactgcggcagggtcttcgtgaatctccttgtccataaaggaatcccagccgcccttttcggcggccgaagcatcccaatccacggtgtaggtcttcgggttttcgaccacgttgccgttgaaatcggcgacgatgaccttgtcggcggacacgcatacggcctgatcctggtcgacttccatggcgcgcttggtgtaggccacgaatgcggcgacgtcggaaccgaggaagttctccccctcgccaaggcccacgaccagtggcgaatcatggcgggctccgaccacgatgtccggctggcggcagtcggtggccagaatggtgaacgcgccttcaagcatgcgggccatgcggcgcacagccttgaacaagtctggcttgccttcgtccgcgataatcttgtccacgatcttgccgagcagcttagcggccacctcagtgtcggtggcggaggcgaatcggtagccttcggcttgcaggtcgaaacgcagctgagaggcgttttcgatgatgccgttatggatgatggccaccttgccgtccatgctggtgtgcgggtgggcattcacgtcgctcggctcgccattggtggcccagcgcgtgtggccgatgcccaccgtggcaagcggcatcggcttacgctcgatgtcttcgaccagattcttcaaacggccggccttcttgcgcacgaccaccttatccatgccgggcgcggtcagcgccacaccggccgagtcatagcctcggtattccagacgttccaggccttgcaggcagacctccaaaggcttgccgcatgccgtttcaatatttcccgcgtatccaacgattccacacatggttcaccagcctagcggacgattattgcgcaaagcgaatccaacccgccgcctttgcaggattggaacatgccccttcgtgaaaaccgtacactgactaccactcagcgtacgttcttcacgagatgggggtgcgattaggcgtcgcaaaaaaacgtacgctgagttcatcagcgtacgtttttggagctgcaacaacgagccttcctacagcacgtgctgcaagaagtccttaaacctaggctcggtggggtggtcgatgatgtcggggccgcccttttctacgactacgccgccgtccatgaacacgatctggtcggcgacttcgcgggcgaagccgatttcgtgggtcacgcacaccatggtcatgccttccttggccaaggaacgcatgacgttgagcacttcacccaccagttcggggtcaagggcggaggtcggctcatcgaaaagcatgatctccggcttcatggccagagcacgggcaatggccacacgctgctgctgaccacctgacagctgggaggggtaatagtccatgcgatcgcccagaccgacgcgctgaagctcggccacggccaggtcacgggcggctttcttggactggtgctgcacgtgaatcggggcttccatcacgttttccagcgcggtcatgtgcgggaacaggttgaagcgctggaacaccatgccgaggcgagaacgctgtgcggcgatctccttatcgtccagggtctgcagcatgtcctggccgtttttggtcacgtgcttgtagccgatgagttcgccgtccacctcgatggaaccgccggtcagggtttccagctggttgatcagacgcaggaacgtggacttgccggaaccggagggccccagaatcacggtcacagtgccgggcataacggttagatcgatgcccttgagcacatgcagcggcccaaacgccttgtgcacctgcacggccttgacagcaggaatcacggaaccgtcaaccgccttgcgcacgaccggagcggagttggtgatgtcgttcgtagtcataattctcgctcccgccttacgcattcagcccagcgaaggtggtctgattgattttgttcacatcgtccttcggctcgccgtcagacttgccggggtacggcggatcgtatggcggctgcttgcccttggtgcccaccggtcgggcatcgaagcccttgccgaagtgcgcctcgaggcgggactgcacaaccatcagaatggaggtgatcagcaggtaccagaagcaggccacgagaagcagcggaatcggcttgtagatacggttggcgatggcgttggtggcgaactgcagttcgagggtgaacggcacggcggtgaccagcgaggtggtcttcagcatgccgatggtctcgttgccggtgggcgggatgatgatgcgcatagcctgcggcagcacgatgcggcgcatgatgagcgtgcggttcatgcccaatgccttggccgcctcggtctggccggggtccacggcttcaaggccggcacgcacgatttcggacaggtaggcggcctcgttcagagccaaaccaatccatgcggcgttgaatgcggtgaccaccacgttggagtcgatgctccagaactccaccgaggtgtgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgccggcgagcacgctgcgtgtcagggtcaggctgcggctcatcttcaggatgcgttcgcttttctcggtcgtggacgcgcgcctgcgtcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgatcggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaggagctcgccggtggcgggcgatgcgagcgtgaccgtgtcccaccggatcgcggccagcaccttggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccggcaacctcgggcaacacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgagtacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaaaccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctcccccaagcaaaccggcaatgtagcgcgcggtcaatcccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcagcctgctgcaccggagtggcgtcggaaggcagcgccgccaagcgttcgcggcatacggcaatcatcgcctccacgttcgggccgggaatggtgagcgctgaattgaatcggtacagcggtttataggcttccttatggatatgcgcattgtccacgaaggcgatgccggtcaccgagtagctgaatatgtcgtgcggctcagggatgaatccggtcatcaccacggagtcaaaggagtcgatggtggtttcgagttcggtttcgggctgaatcttcacttccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcgggcgcacggttttttcgccataccaccatagcatttgaacccgtcagggtgtcaggtcgggatcagggacgcttggcgtccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagatcctccatcgtcaggccgaagcgcgtgtacaggtcgatgcgttccagatatttgccgatgaagatgaacgccttcagcgtggggtcgaccggcgaattctcgatgccgccccagaaagcgagcatgtcatcggtaatatcgcgctgcttgtagatgtcctcggcatcggccgcgtatttggcggcatcggtgatattggtcatcgccaactccacgtactgcagcagacgcgagctcaattccgggcgcagaatcacggcgttgttgaatgcggaagttacggccgaccgcaccgaatcaggattggacccgtcgtacaggaagctgttcacgaacccgtcgaagtcctcgaaatcttcgggcaggtcgagtgcgtgagcgaacggacggaaggcgtccacatcggtgtccatcacacgatcgtagaacgggaagaactggttcagcgtggtgaaggcgcgctcggtgtatcgacccagccaatacaggttgtctgccttggaagcggtaaccagcgacaacgaatggtggcgggactggctcagcaggttcgccacctgcgtttcggcaccgtactcgtgctccacgccggattcgggtgccaacacccacgtatccttaaatccgccaccctgcgacgagttgacaatcatctggccaggcaccgacgagtatcgagtcaagcccgaataccacacgtgcgtattcttgccggtgaccacgaaggcacgcaaatcgcacttgcgcggcgacatctcgccggtcttcgggtccaccacatcgatatcacggaactgaatcacctcttgggcaatgaatcgacgcggctcctccttgatccggttggcgagctcctcacgtgcggcggcatccagcgacgaaccaaacaccacgccgtaaccgccggcttcggccacatccttgatgaccagctcgcccatccgattcaggacttccttgcggtcggcctcgaacatcggcatgtacgtgggcgcgttgttgagaatcggttcctcgccgagatagtacttgatcatctgcggcacgaagtagtagacggccttgtcatcggccgcgccgttgcccggcgcgttgacgatggccacgttgcccgcgcggtaggcggacaggataccgggcacaccgatcaccgaatcaggattgaaggcgaacgggtcgaggaattcgtcggacaggcggcggtaaaccacgcccacacggtggcgtttgccggcgtagtcgaggaagtagaccttgttgtccaccacttcgaggtcttcggggaaggccaacgccgcaccggttttctccgccagataggcgtgctcgaagaacgcggaattgtagcggccgggagtcagtaccacggcgatgccctcggtggagacaaagtccatggctttgcgcaacaggcgcgggtattcgcgattatcgcgaatacgaacgtcgcggaacaggcgcggggagatgcggcgctcgatgtcgcgcacgaacagcgggtagctggcacccgagggaatacgcaggttgtcttccagcacccaccatcgtccgtcctcgccttggaccaggtcctcgccggcgatgtgagcaaaaatgccgccgggaggggtcacgccgttgacctgcgggaagtagccggccgaggtgtatacgtattcctccggcaccacgccgtcatggatgatggccttgtcggagtagatgtccttcagataggcgttcagggcgttgacgcgctgcttcaagcccttctccaattcgtcgtattcgtcggattcgataatgcgcggcacagggtcgtacgggaacagccggtcatggtattcgccgttcttgtagatgccgaaacgcacaccgttgcgggacagctctcgattgatcgcttcgcggcggtttaccagttcatgggccagtctgcgtgctgcggattcgatcatcgtgcctgctccttgctgtggcggcttctgtggcttcaagcggttaggcgtgttgagcgcacgctgacgccgcaagccgtaaccgggtttgatggtttcaacctaaggcgggcccgtttcaacaaacgcgcgagaatgttacaggcaggtcacttcgccggccgcgtgcatcttgacgaccgcactcgtctcgccgaccgcactcgttacaatgaatggctatgacacgactgcgcattgacttggcctacgacggcggcggattctatggctgggccaaacagcccaatcttcgtacagtgcaaggcaccattgaagatgcgctgcacaaggtgctgcgggtgccgaccgatgacgcggccgaaccgttacgcttgacagtggctggacgcaccgacaccggtgtacatgcctcccaccaagtggcgcatctggatgtatccgatgaggtactgaatcgctgcgtaggtcacatgaccattccggtcaccgaggcgctgactcgcagactcaaggctgtgctgccttcggacatcgtcattcatggcattgccgtagctccggtcggcttcgatgccaggttctccgcattggagcgcacttatgtgtatcgggtcgccgatcgttcgtctgaggtcgacccgcgcctgcgtggatgcgtacttaccgtggatgaagcgctggatctggagcttatgaaccgcgcagcctcattgaccatcggcctgcacgattttggttccttcgccactccgaatccgggaggcactacgatccgtgaagtcaagaccgcctattggcggcgggtgccgatcactcccctagtaccggatgagatggcatcgcatgaagcatatcggactccgtcgctggagtccggcctggtagtgttcacgattgtggcggacgcctttgcccgcaatatggtgcgctccctggtcggctcatgcatcaaagttggttcgggacgcaaatcactggagtggtttgccggcaaaatggccgagccagtacgtgaaggctcaagcgggccgattgcgccgcagggcctgactttggagcatatcgcatatcccgccgatgatcagctggccgcaagagccgaggccattcgggccgtacgtacgttgtagattctatgaaaacaacgcaaaagggctggaacccaaacggattccagccctttcagctagcttagcgaaacgctattcagctcactcggccttctcggcgtcagcggcttcctcagcgggagcctcagcctcagcggcggcggtctcctcgaccggagcctcaacagcctcagcagcctcagtggcctcagcctcaacggccggagcttcttcttcggcaaccttggcggcggcttcagcttccttcacaacagccttcttggcaaccggctcggtgacgagctcgatcacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccacgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcaggcaagcaggtgggcatatgcccgaacatctgcttgcctagtgaacgaacgattggtcaaagaggcagatcactcgtcttccggcgagaagaacgtgccaccttcgagattattggtatcgaaggccatcggcgaggacttgaggctcaggcccaaggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcaatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccaggatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccatcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacacccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacctcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggcgctgccattgaccctcgtttcctagtaacgaactttgttgttgacgttcgggcgatgggatgaaaatcatcccgtggcccgaatcatgccaccgactacttggtggccttcttctttccggcgaccgtgcgcttcgggcccttgcgggtacgagcattggtcttggtgcgctggccgcgcacaggaagtcccttacggtgacgctggccttggtagcagttgatctgaatcttgcgacgaatatctgcatcgacttcacgacgcaggtcaccctcgatcttgtagttggcttcgaggtagtcacgcagcgtaatcagctgctcgtcggtgagatccttgacgcggatgtccgggctaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttttcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacactcggcgtgtcgcacaggggtatggaaacgttgatgtgatatttcggcatcactccggcttgttgcccgggctgccgaacctactactcgaggtggctgatgatacggccgctgatctcgtcgatgtcgccgacgccgttgaccacgacgagcaggccacgggcctcgtagatgtcgagcagcggagcggtttccttctcataggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcgaggtcggcgagcatctcgtcgagagcggtgacctgggcggcgttacgcgggtagccgtcgaggatccagccgttcttgcagtcttccttggccagacgatccttgacgatcttgttggtcagggagtccggaaccagctcgcccttgtcggtgtagctcatcgcctcaaggccgagttcggtcttgttcttgatgttgtagcggaagatgtcgccggtggagatggtggggatgttgaagtgttcggcgagcagagcagcctgggtgcccttgcccacgccctgggggcccatgatgagcagacgcatggtggtctccttttatgtcggttattaatacggttttggctcccttggttaagggagccattgagttatatgcggaagaaagattgctccgtcgtggaacagtccactggactgttccactcctcgcgcggccgcctgcccattgcgggcgaccgctgccaagcgggcgtcagccctctttgtggtccacgttttcgaacaggaagccggtgtactggaactgttcggtctgggccttggcctgacgcagggtgtcgaggcccacgcccgcgatgatcaggatcgtggtgccgccgaacggcagcttggcgttgaggccgagggccatgatcagcacggtcgggatcagggccacgaacagcaggtagacggcgccgacggtgttgagtcggttcatcacgtaggtcaggtagcggctggtggcgttgccggcgcggatgccggggatgaagccgccgtactgcttcatgttgtccgcggtctcgtccgggttgaacgtgatcgaggtgtagaagaagcagaagaacacgatcatcagcgcgtacagggcgatgtaccacacggatgtggtgttcgccaggttggcgttgatccacttgacccaggactggtcggacttgccgaactgggcgatcagggtcgggatggcgaggatcgaggaggcgaagatcggcgggatgacgccggacatgttgatcttcagcggcaggtaggtggaggagccgccgtacatcttacggccgatcatgcggcgcgtgtactgcaccgggacgcggcgctggcacagttcgacgaagtcgacgaagatgaggatgaccacgagcacgcccacgacgatgccgaacttcagccagtcgccatcggtgccgtcggtgccgtagccgatctcccacagctgcggcaggaagccggagcagatggacatgaagatcaagatggacatgccctggccgatgcccttgtcggtcacgagctcggccatccacatgatcaggccggtgccgccggtcatgatgaggaccatgaccacgaggttgaacacggagccgtccgggatgacctggtcgcactggtagttgaacagggcgccggagcgggcggtgaccaggatggtggtggactggagcacggccaggccgatggtcaggtaacgggtgtactgggtgagcttggcctcgccggactggccctccttgtgcagggcctcgaagcgggggatgaccacgcgcagcagctgcaccacgatggacgcggtgatgtacggcatgacgcccagcgcgaagatagacagctggagcatggcgccacccgagaagaggttcaccagtccgatgaagttctcctgggaggcgctgccgatggtggccatgcacttgttcaccacgttgtagtccacgccaggggtcggaatgaacgaaccgatgcggtagacgatgatgatgaacaggacgaagagaatcttcttcctcaactctttggttttcagggcctggattagtgtcctcacctagatttcctcccaatagcgcgccaatcgcgcgaaatacacaaactaacgaacgagcatagtctaaagtgcctacttcggccacttcatgtctcgcgaatgttacctgaattatgctccgtcgtactgaacggggggaagcatactcaaaacgatcattgtgttgagactgcttctctgcactcagaacaacaattttttagaaaagggacccccgtccacctattggcgggcgggggttgtacagcctattgcgctccccgtaggactaatcagtcctcggaaacggaaccgccggcggcctcgatcttggacttggcggaagccgaagccttaacacccttgagggtgaaagccacggtggtctcgccgtcgcccagaaccttcaccggagcgttgtcacgaacagcgcccttggcgatcaggtcggccacagcaacctcgccgccctcggggaagagctccacgagacgagcgatgttgatgacctggaactcgaccttgaacgggttcttgaagccacgaagcttcggcaggcgcatgtacagcggcagctggccgccttcaaagcccggacgcacgtggttgcgcttcgtctggcccttggcgccacgaccggcggtcttacccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcgcgggcgcgcagcagagcatcgggagcgacctcgtcgagcgccaggccacgacgggcggcgatctcctcgggctcttcgagctgcttgagggcgtcgacggtagcgcgcaccacgttaacggcggtggcggagcccatcgacttggtcaggacgtcggtgatgcctgcgcattccatgacggcgcgcacggagccaccggcgattacaccggtacccggggcggccggacgcagcaggacggtgccagcagcgtcgtgaccctgaaccgggtgggtgatggtgccgcggacgcgaggcacagagaacatgtgcttcttggcgtccagctggcccttggcgatggcggccgggacttcacgggacttgccgtagccgacacccacggtgccgttgccgtcgccgaccacaaccagtgcggcgaagctgaaggtacggccacccttgtgggtcttggacacacggttgatggtcaccacgcgatcgagcagctcgtcgccgtggttttcttcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagagtggaggcagacaccagggtaatgcccttggtatcgtcgaccacctgagcaaccatgtgacggttggagcgggtgaccaccaggcgcggacgctcgggggtaccggagatgcgcttgcggatacgcgcgtgacggcgcttgagagctaccttcttgccttttccgagaatagcaacgctcatatcacttaccagcctttccagccttgcgcaggatgcgttcatcggagtacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgccctggcccttggcgacggcgcggtaaccggtgccgacgatctcaagagtcttggagtagccatcgtgaacacccttgaccatgccggccatgatggaacgagccagaccgtgcttggcacgggtcggacgcaggtcatcagcggcggtcaggacaatctcgttgccttcaacggcagcggtgatgccttccggaaccacgtaggagtcagaacccttagcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgataccctgaatggaacgctcaccgttcggaccgtacttgagggtgacctcaagagtctggccgaccttggcttccttagcggtgaagtccttgatgtagccttcacgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcagcgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcgccgatggcctggccttcacgcaggtggaactgcgcgacggacttcttggccttggtgatcttcggcttctggccggtgatcagggtgaggtccttgacggcaccttcgatgagcttggagtcgcgggcagcggcaccaacacccatggagacgacgaccttctggacacgagcaacctgcatcgggttggagtacttgaactccttctcgagctcaggaatgatctgctcgttgtacttgaccttcaagcgcggggtggccggcgcctcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcgacgattagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcgcgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtagcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgatgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatggcgaaatcaccgaagttgatctcgttgccgcccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggctcatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcgaacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatgcgagcagcgcggccctgggcacgagcgcggaagcgcttgagggtcacaccttcgtcaacgtaggtctccttgatgtacaggtcgttctcgcggaacggctcgccggccttgtcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgggaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgaacctcgcccttgccccacggggagaccggcggcttaccaccgcgggtacgaccgccgtgcgggtggtcgaccgggttcatggactcaccacgggtgatcggacggcggccgatccagcgggcgcggccagccttgccgagctgaatgttggcgtggtcctcgttgccgacctcgccgacggtagcgcggcagcgcgcgtcgacgttgcggatttcgccggacggcatacgcagctgagcgtaggcgccatccttggcgacgagctgaacggcagcaccagcggaacgagcgatcttagcgccgcccagcgggcggagctcgatggcatgaaccacggtaccggtcgggatgttcttcagcggcaggttgttgcccggcttgatatcagcctgagcaccggtctcgatgacgtcgccctgcttgatgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctaaccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacgaaggtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtgatcggggccagagcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgacggtcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcagccagttcctggccggcctcgaactgatcgacgtcgtcggtgcgcacctcgacgaggtggcgacgcggggtgacaccggccttggcaaagtggccagccagcggcttggtcaccttggtgggatcgatggcgccgtagccgagctggacagccttgtagccgtcagattcctcggtcttcacagcggtcaccacgttggtggacacgtcgacaagagtgacgggcacgaagaagccgttctcgtcccacacctgggacatgccgagcttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacttgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagtggagttcgcgcgtgtcgcgctcatgccgttcgtattacctcgcggcatagccgctcggcgtctgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctgcccgctgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgcgtcgtttggcagcactgttgagacggcatgtgttatgcccatcaacgcagcacatgcctcgtgcgcagccgctgatgtcaccgccgcacgcaccgcgattcggaatatgccagatttgagccagatattcgaccttcacgcctggtggcccgcgggttcattgcccgtgagcgggctgattgccaccgtgctgtttgcgctgacgcagtatgggtcggttttggtggtcaaaaccatgatccgggaacgcgggaagtgttcatacgtggcggcttcgtgggtatggcatgtggcgctattgctgctagccgccgtgccgtctggacgcagtccgtatctgattgcgatgactgtgctgctgttggcccgcgccgttgcgttgccggtggttacacggcgcacaaccttgaagcccgtggtgaccggcattaccgaggcgtttgccagctttattgcttttggctgcataattgcggcgatttagcgacgcttcagcgattccatggggtggtaacccactcatggggcggtaattgacccatggggcggacggtaaaattttaccttccgcagaatagagccgtttttacaccgccccatggggttttcaccgccccatgggcaagttaccgccccatgagtgggttaccaccccatggaggtgtacctgctggctgagggagcaccacatatgcaaaggagcccggcccctgtaatggggtcgggctccttgtgtcgcgctatgcagacactaagctgcaacaccgcggttggtggctactgatggtgccaccaaccacaaaccgcctgcaatcaacgctcggaggcttcctcagtggcggcctcaccctcgcgctcgatgcgcagcttgtggccttccgcctgggagacaccgtagtaagcaccgacggcgatgtccttcatgtcgttgatcagcgggatgcgcgggttggccggggtgcactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatatcctggtagcgttccggggcgatgtacttgttgtacttcggccaagaagtgggctcctcaggaatctggccgttgtaacgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttagagcgggcgcgcagctggtcgatgatcttgtcgacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcattgtagatgtcgccgatgccgccgagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagcggctcgtcgtcggagacttccttgcactcggcggccagaatggtggcgtcggccggaatctcgaagccagcagccttggcgatgaactgaggggacttgcccggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcctgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgcccacggtcttctggccggccagatagttggtgacgtgctcgcaggcgaagatgttcttggtggccttgtcttccacgagaccacggccggtctcgtcgacggccatcttggcgagaacgaggtgcttgttcagagcggcgatggatgccttggcgacgatacgatcaacttgcttctggtcgaggttctcgaattcgtcgagagccttcttggcgcgggcaaccagcgcgtcaacctcggcctcagctgcggcctgcttctcttctggggtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcacatgtgacctgagccacaatataccgaacggttcggcacgatgcacacgcacaaaatcgacggcgtttcacgtgcgatattgaacagtttttgttaagagttgtgcgaaatatcgaacaaattctcactttattcggcgatttggtactttttgttcactttttaccgaaaatcacatgcctgcaaacaacgcaatccgacaacttttttaaatcaagtttccaaaagtactcattttctccacatttctagaaaattggtttaaaaaagtacccaaatcgcctacaaatatacgatttttgtctcacaatctccgcgtcgaggcacatgaaagccactttcataaagtatacttgcatatatctcatcgcacaaaggggcaaatatgagggcaatgccatcaactgcagtgaaagcgcacaaccgcagtgccatgacccagtatctgtatggccatagccatgtcaccaagcaggaactggaacgcgagctcggcctcagcctgcccaccatcacccaaaatctgcgcgccctagaagatggcggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccctgacgccaccaccatcaccttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgtgtctatctggagcgacgcccaggcggcgcggtgattgtgggaggcaagctgtatcagggcccgaaccagtgcaatggcgccatcgaacatatgacgctggtaccgggcggtcgcgaatgctactgcggccagcgcggctgcatggacacctactgctcgccggagaccttgcccgaggattacgaaagtattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctgaaggcgcgcgtcatcgcacgcagcccgttcggcaccgaccatttcaatctgcgcaagagctactgcgccgaagaccagaacatcatcggtgccgcattgcgattcgccgagaattatctcgacgatatctgtggtgctgcggtacgcggctgatttccgcctaggcggcagcggtttcgggactcatggagacagtcatagaacaccaatcacggcaaaccggatgtcaccagccatggccaagcatacggccaccgcaagcacgaccattaccgcagtcactaccggccataccgaattatcattcattgctgcctccttggagccgatgcactttatgcgcatctaaccacttcgttgtattttcaagcctaaacggcagcattggccctatctgataccaagaaacccacttatggtactttcttgcacggatccgtgacaccgcccagaccggggcggcaatcaatgttctcggcgatattgagatggagtcataccggtttcttccagaaaccgacgattgaaattcgaggcattcgtatatccgctcaactgttgaatcttggcaatgggcatgtttgtgcaagtcagcaaacgacaagcacgccccactcgaagccgtcgaacaaaatcagcaaaaccgatgccggcaactcgcttgaagaagcgagaaaaggtggatacgctcatcgccgccgcatcagcggcaccttgcaagctgacctcatccagatgtgtggaaatataggtgatggcggcgttgatcccatcctccgcgccaaccgcaatctctggattgtattccggcgttaccacggtctggctttcctgcgctgatgcctgctcgaataccgtcagaatagcaataaggtcggcaacccgtctaactggactatgttctcccatggccactaatagctcgccggcctcacgtgccgaatcaccgaacaatacaagtgcatgctgcgaacggcgcaataccgtctcgaaaccggaagtctcgggaaaagcggcggtcaatagtcgcatagtctgcggacgtatatggcataacacatcacgatgagagagccgttctccaggaatgatatccgacaaccaattatgaggcagattggatccgatcatcgccacatgccccggcacgaatggcatgagtccatcccccgccatgagttgtccacttccctcacggataagatgaatttcgatttgtggatgataatgccatttggccagagagctcggatacccgtggcttgaccaacgtatggccgcatccccatcgggcacaatcacttccagcgagcccgcatccgaatgaggaatcgcagtcaagtttcgcgcatccatcgcagacctccttgtcaacgttgcgcagtacagctcgccatatttcgtactttaccgatggaacaactacggcgagatgattgcccgccggaatcctacggatatggcacataagtgcaggcggaaaaagggaaacgccaacatatgccgcaggatttcatcgggcaatcatctcgtcatcaacacgtcacagattagtctcgattgaccgtaatctgcaatttgatatcgcccggacgaccctcatccatacggtcgaaggcagccttggcgtccttcatggcaaacgtgtcagtgatgaacggcttcaggttaagtcggccgctatcgaccaaatcgatggctttctggtacacattggcgtaacggaagatgttctcaatacgcacttcggtggcctgcagctcggtcacgtcaatcggtaccgggttgaccggaataccgacgagcaccgcgcaaccgcccggggcaatcagcttccagaacgtctcataagctttcggcgcgccggaacactcgaatgccacatcagcgccccacccagcggtctcttcgcgtacacgttcaaccaagtcctccgtcgtcaaatccacggggataacgcccggaatctggccgataatacccagcttgatggaagacacatccgaaacaagcaccttggaagcgccaccggcgagcgcagcagaggcagtgagcatacccactgtgcccgagccggtcaccacgcacacatcgccgggcttgatgcgcgccttggtggcagcccacatgcccacggcggtcggctcaagcaacgcaccttcgccaaagctcatggaatcaggcagatggtaggtgaatgcggccgggtgaatgacctcctcacacaggcaaccgtcaatcggcggagtagcgaagaaacgcacagccggatcgacgttgtacatgcccagtcggctggcccgcgaagtcatatccggaatgcctggctcgagggcgactcggtcaccgggcttgaaatcagtgacgccggggccgacctccaacacggtgcccgctgcctcatggccgagaatcattggctgctcaacaacatacttgccaacacgaccgtgcgtgtagtaatgcaaatcagaaccgcatacgcccacggtgtggggtgcgatacgcagctcaccggggccgggatccttgacgtccgggacctcacgcacattgatgacgccctgctcttcgagaacaactgctttcatggtatttctccttatattggttgaatttttttgagggtcttgtattgttggtttttgacgagaacagtcagcgagcaccgctcagttcgccgccactttgcgggtgatgcccggctgctcggggcgaatccagaatgagatgaccgagccagagatgtagcaaatggcatatgcccagcacactccggcaaaacctacggtattgagcagtaccgtggcgatgaacggaccacagaatgtggtcaggcctgaagcgaggttatgtgcggaaaccgcagcgcccttgtgctcaggttccagagcagggaatactgcgcccatcggtacgaaagcggaaatacccatgccgagcaccacggcgcacacatacataaatggcaggttgtgcccaaacagctgcggcacatagtacatggcgagagtaccgagcgcggagagccagcagccccaccagcgcatctggctcatccagccgaagcaatcgcccatacggccccagaacacattgccgaatacggtgacgacgaacagcagaccccagatggtggaccattcggtgacctggtaccaagctccgccgccgtttgtatgcgtggcgagatacagcggcataatgaccggaaaaccgtacaaagtgagattgcaaatcacacgcaatacggcagcaagcgcaatctggtggttgtctttgagaatggtcacgccgcgagagagttcacgaagcttatccgaagagctcatcgtgtcaagattggcgttacgggttttcggcacaaaacacagacagataatcatgccgacaatcgagaacggcagtgacacccacagcgaatagtattcaccaatcaccggcgtgatgaacgccggcagataggcgccaaacacaccgatgccaaaggaataggaagtccagaaccagcccatggccgatgccagtttgccgggatccacagtttgcgcaagcaacactacgaagctgtagataaatagcggatagcccatgcctcgcaacatatacgacgccagcatcagcggataactgtggctaggcaatgccacaccgatgaataccagatgcagcacgatccaagaacccgcgccaataagcatgatgcgcttggctccgaacagttcggccagcacgcccgaggaccagccggcgagcgccgcgaccaatccgtacatcgtaaacagcagtgatgcctgcgacgagctgaatccctgatcgacgacatacttggacaaaaaggtcagttcaaacccatcgcctgtcatgaacactgcgatcgccaagaatcccggcagtagttttcgcgccagtccttgtgccatgaccgtctccttttactacgcaaacttcgttgttttcatccgcccaactttggagcgttaatacaagtttcgctgcgaaaatagcagtgttttggcgcgaaaacagtcaagaattgatactttcttgcatggatgttgttatgcccagcgtgctgctcattgttgtaacccagcacaatcatcaggcactaaaaaaacgaccggcgcatgtgcaccggtcgttgaatgttagttatcaggccagcccgtaataaaggctgagtattatattgcggccactatcgacacgcatattgcgcgcgaatcgggcgcatcggagccactactcctccacaatctggcagaattcgatggtctcgccgttggggccgtagatgttgaagtagcggatgccatgcttccagaaactcgggatggactggatctcggtgtccttgaagtccacgccgagcgccttggcgttctcgaaggcggcttcgatgtccggggtgtcgaaagcccagtggttgatggcgccggtggtcatcggggcggggtcgccttcccaggtttcaatggtcaggtggccgtagcgcaggaaggcgcaacggttctcgccattcatgaacagtccggcgagctcaaagcccataacctcgcggtagaacttgatggtctcatccaggtctttggcaatcatgccggaatgctggaggtcggtagtgaacgcggtcattggcttagccatgtgattctcctttgaatgtggtggttggataaaggttaaggatagtcggacaaggtatgcggcgcggcagaaccatgccgcactcctagtcaattctcgatactttcttgctgacgcaacatgatgttgcgatcagttcgcagtggcaaccatttcggcggccacggttacttcgggcagctaaacgtgcacggatgcgctgtcggtaggttccgaggactcggaggactctgcggatgcaacctttgcgcctttgatgcggtggcctttggcgtcgaagccgggctgctgcgggcggatgaacaaggtaagcacgaaggcgagcacgtataggccggcgtatgtccagcacacaccttcatagcccacaattggcagcaaaatggtggcgatgccagggccggcgaacgtggtcagaccggcggcgaggttgtatgcggacagcgccgcgccctgcttgccgcccgcgtacagggtcatgatggtgggcagcgacgagaacgcgcaggtgccgatgccgacgatgaccgaagcgacgatcatcataatggcattcgcgccgaaccactgcggaatgtagtagaacgccaccgagccgaccgcgagcaccgcgcagccgaaccagcgcatcggccatacccagccgaagcggtccatgaaccagccccagaacgtgttgaaaatcagcgtgatcacgaacacgaagccccagatacgcatccattcctcggttttgaagatgttgatgccgccattgtgggtggtgcacaggtacaacggcatgatgaccgggaacccgtagagcagcaggttattgatgatgcggatgatcgcgcagatgagcaccttgcgattggtgaccaggatggtggcaccctcggccagctcggcgagctgttccttgcggctcagtccttgcgatttgacgattttgttctttggtacgaagaagaagcacatgacggtgccgacgatggagaacggcagtgcgaaccagaaggtcttgtattcgccgaacaccggcatgatgaagctcggcaggtaagcgccaaacacgccaatgcccagagagaagcaggtccagaagaagccggtggcggaggccaggcgggcggggctgatgtattgcgccatcaggaccacgaagctgtagatgaacagcgggtagccgatgccgcgcaaggcgtacaggcccagaatcagcgaatacagaccactcgggatggcgaccccgagaaacagcaggtggatgccgatccaccagcaggcaccgaacatcatgatgcggcgggcaccgaacatttcggcgagcacgccggcgcaccagccgccgagggccgcgaacaggccgtacacagtgaccagcagggaggcctgcgaggacgagaagccttggtcgaccatgaatttggagaggaaggtgagctcgaatccatcgcccgtcatgaagatggcaacggcgaggaagccaagcagcaacacacggggaataccgaatttttcaaaaaagcgaatcatgggttgactccattaacatcgttgtcagtagaggtggtgcagggaaaaatgcggccgccggaagaaaaagggaaagccggcggccaagctatattggcggcgaaaaccgtgagacgaaacctcttccttccgctggcgggaggtggtgcgcagcaccggagggtggtaatacacgccgccggatgcctcccctcagtcggctccgccgccagctcccctcagggagaggagccggcaaagtgccgaaactactcgccgaccttgacgacggccttggagacgccctggatcttgccgtcgaggaagtcctggacttcttcgagtcccagttcgtggctgatgagcggtgcgacgttcatcttgccggattcgagcaggctgatggcgtctttgaaggtgagcgggttgatgaaggagccctgaatggtcagctgcttcttatagatatcgtaggtgttcatctcgaagtgcgcctcctgcgggcccacgccgaacatgagcacctgcgcgcccttcttggcggcggccacggcctgcgcctgggtggccggcaaacccacggcctcgatgatcacgtcataggattcggcaggaatggcctcgcgcgtggtgttgtagacgttcgtgacgccgaacagctcctggttgcgcttgagcttctcatcgaagatgccggccaggtccacctgatgcacgccgtaggcctgcacgatctgggcgaagagctggcccatgaagccgtctccgatgaccagcgctttctggtaggggcgcagcttcagcaggtccacgccgtgcacggcgcaggagataggttcgatggcggcggcgtccttcagcgagacgttgtccggcagtttgtagactacggtggccggtgcggtgaactgttcggccagaccgccgtcacgcgtgacgcccacggcggaaagatggtcgcacagttcggggcgctgggtcaggcagtactcgcactgaccgcagtagatgttcggatcgacggccacgcggtcgcccaccttgacaccagtgacctcggaaccgatggcggccacgacgccggagttctcatggccgagcacgatcggcggcacggcggcggccgaaccggggcggccggcgtacaggtcgtgatcggtgccacacacgccggcgtaggcggtgttgatcagtacttcgttgggctggatttcaggagtgggcaggtcctggatttcgaattccttgacgccggtgagcacaagagccttcatgatgggtcctttctacggtgaaagcgcgccactgcgatgagcaaggttgggccgggtgaccgggtggctgggcaaccaggtgaccggccggcaggcctatctgcatggcgattggtcgcgtattggtttcgttcatctcgctgtctttgcgaggtgttgatgaacagcataacttctttatctcagttttgcaaattatttttataaaactactttcattcggcgtgttgccttggaaatcaagggcttccaccaaaagtaacaacacgtctacaatggagttatgagaaatccaccgttgcatcgttacgccactcgcccagggctgtacttcactgacgacggtggtgctgacgtcgttgttcgttccgaaaccgccgatcaggtttggttgtgcgtgctggagcccattgatgagcccagcgctttcttccaagacgccatccgtctgttcgaggacccgaatatctcctttatccagcagattcatgagttcccggtgtgcacgcgcatcatcgaacatttgtatctgcgcgagaccctgtttcgcatgaccgggccgaactacggcctgtggtacgtgcacctgcccaaagcatgggacggcatgcgctatggctaccgcgtggacggcgcatgggacccgaaacatggcgtgcgcttcaatccatacaaattcctgcttgacccgtatggcaagggcatcgacggctccatggagctcacccccgccgccttctcctatgaatgcgatgtcgtggaccacaaggtaaccggttcggcatacggtgccatgagcaccgtagactcgctcggccatgtgccggtgtccgtggccatcgacgatcgcgatatccataagcatgagggcgacccgcagcacccgcatgtgccgtggcgcaaaaccgtcatctacgagatgcatgtcaaaggcttcaccgccaacgcgccgtggctgcccgaagcgttgcgcggcacctacgccggactcgcccaccccacaacgctcgcctatctgcagggattgggcatcacctccatcgaactgctgccgattatggccaagcaggacgagctcttcctgcaagaacacggccgcaagaactactggggctactccaccctcagctacttcgcccccgaaccctcctatgccaccaaagcagcccaagagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggccgactcgaagacaccaccggctgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggtaacctgaagctcattatggagccgtgggatctgggcaacctcggctggcgcaccggccaattctccgtgccgttcgccgaatggaatgaccgcttccgcgacacggcccgcaccttctggcttgaggatgtggacggcggctccgatttcgggcgtatcagtttgcaggagatgtccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggcaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacactcactggacgcctaaatggtgctcggccgaaatcaacggccgtcgagccgggcatggcactcaggtcgaggaatgcgatttgaacggtgacaccaccgtctggacgcagcatgtaccggacgccagcgagacagtactcaagatggtcaaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacagcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacggttcttcggcagcatgcccttgacagcgttcttgatgatgcgctcggggttcttctcgagcagctcggcgtaggagtcacgacgcagaccaccgggacggccggagtgcgagtagagctccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccgggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgcggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcgtgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcacgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgccctcctcgccgttgggcgccccccacttgtcgtagcacaggcaccacgtggcatacgcctccaagtcggaaccacagtccgccttgaattggtcgaatacgctttggcgttcggcggtacggccggccttaaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattaatgagcacgaagtcggcaccggtcttctgcttggcgtccaccagcatggtcttcagatcctcgtaatcgcccacgccccaagagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccacataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcggccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagcggcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcgggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggcccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgcctatgggatggtcgctggatatcgggcaccattggtagttgccttgatgcacgttggcggtgggcacccaatcgatgcggttgacgcgccacgaccccttgacgcccttcttgccggcgaactggatgcgtgcggtcacaccctgattgttgaccaaggtttccggcgtgttcgccgactcggtgacggcgttgcccagaccgtagataatccacgtgccgttatagttctcgatgggctgcgcacaatggcaaccggcaccgtaaataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggccttgtctaccgcgcgctggatgtcgctgtcgtgattcgggtcgccgtcttcgcgcagacgatccacctgccagtcctcgtcggcggtcatgccgttgagggagaccgtgccggtgaccagacccagcttgccgccgccggtcggggaatcgatgaccaacggtttggtggagtcggcttcggttttgtacgagccggtctgggcgatgccattggcctcaagcgtgtcccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcgggccttggaaatggctccacaatccctcatggaacaacaaatcgccgttgaccagcatggcgatgcagtccgtatccgggcaatccggtgaattgccgtgatgttcggtcaccggtttgggcgtgttcttcgctttattcaacgcgacgtccgacactccggcgtgtgcggggccattgccgtccgtgcgatgggttgcgaaccatgcgccgatgcccagcgcaacggcgagcacgatcacgaacacgataatcagcgccgcacggttggttcgtgtcgagttggagcgatgttgcccctgcccagcgatatggctcatctttgcccgcccttcggaactcttcttctctctctagggtaccgcccatctcggtcaagtactgcggggagggaggcgatgagcaagcgattggacaagcaatatataaaccggttaatcttcaatcaccattcacaaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcagcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggggtgccatgcttgccggtcttggacaggctgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggattttgtacggaacagttgcatagtgctcttcttttttctctgttgtttgcgcaccgaatgcgcacaataccgacaatcgagtatagaagagcccgcgtgtcttgtctattaataagactcagagtccgcaatatatgggattaataacccactccatcaatcaatagcgcgattacagcacaccgacgcagaccggttcgggcaccaagtccactccgaacgcgctcttgactgcctgctgaaccgcacgcgccaaagctgcgatatcggccgcgctcgctcccccacgattggtcaaggccagcgtgtgctgcgtggatagactggccggcgcgtccgcatcgaccttatatcccttatggcagccggcatggtcgatgagccaggcggcggacgtcttggtgccgggagtgccgtcaggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgagggaggccagacgctccagatcggtcaggatattggcctcgcgcttggcggtggccatgtcaggcaaggcgtagcgagtagggtcctcgagcatgcccttggcggcacgtactgcgagcacggctttgcggatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggccggccggccggccggggccggcgtacatgctggtcttcagtgcggagtatcgatagccgaatcgaagatcggcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctaccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacggcagaacgcccgcgaggggttcgttcagacgcgggatttctgccgtttctcacgcgatgcggatactgattccgcaccctactactcggctctggagtcaatacgcaaaaacccggccgaatgggccgggttttgtaaagctgtgatgcttgcgatcaacgagtctcgcggtgcacggtctgcttgccgcagcgcgggcagaacttcttgagctcaagacggtcgggcgtattacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctccgggcgcaccgcttttgacagcgagggattcgatgagctcggccatcatgccccgtcccttcccacggtcctcctgcgcgtagcaggcgatgatcttctggtagacgccgtgcgcgagggcgagcggcttgttggacgggtcgccaagcagctcgtcggcgcgtttcttctgtctgtcggtcctgagactggcggtcttgagcaggatcctcctgcccctatagagcggatcggtcctggtgccgcgccggccggtggcctcgcgttggagccggcagcgcacggccgtgaccttgtcgccggcgagcttgacgatgtggaacgggtcgaggatctccacggcatgcggcacctgacgtgcggcggccttcttgtagcccgcgaacgcatccatcgcgaccgcctccaccttctcgcagaacgactgcgggcgctcggcgagccattgggcgaacgccttctcgcttccgccctcgaccacgtcgagcagtcaggccggccgaccatgcctacgcggggtgaggtccacgatgacggtcacgtaccggccgcccgtacgggtgtgccgccacacgtgcccgtccacgccgatcgcctccacgccgtccagccggcgcaggtcggcggccagcacgtccgcgcccttctccagcacggcccggttcaacacgccccacgagcagtgcaggtcacgggcgcatgcgagcacgctcttcgacttgagcacgacctcggcaacggcccaccacacggccgcgtccgtcaaacgtctgccctcgtcggccatatgggtcaggtcgtcggtccacgagcgggcgcatgccatacactcgtaccgtctgacccgcaccagcaggtgcacggcgtgctggccgacgggcatgtgcacgaaccgccgccacgaggagcgaacccggcccatgcccccgcattcccggcaataccggacggtcccgtccaccggctcgcagccgatcagccacactccggcacacgaacccgcggtcacgtgcctttgcgagacgggattcaaacgcagcctatccaagccaagcaagacccgaccatcgaacacgctagactcaataccaagccgcgcggtttcattcacttttttcaatcacacaccgaatcaaaccgcacggcccatacacaccaaaatgcgaagagccgattacgaccccgagcggagcgactctgctgatgcgtgactgagccgcacaacgagttggaatgaataggagaggattgggaagagtgcgtatggtaactatgcccgataccggtgccgtcatggtcgtggatgacgacaagaccgttgcaggttccgcgcacaccgcgcctgacacccaacgacgctgggtgttcgttgatgtgctcaacgtggtggcgtgtctcgcggtgattctgctgcacgtgtcgttgaacgcgttctcgcctgagccatcccgcacgtgggtggaggcggtcgcgttccaggcggtcggcatcttcgccgttcccgtgtacttcatgatcagcggtatgaacctgctcggctatcagcggcgatactccacgaggacgttcttccggaagcgcctgtggcgtgtgggcaaggcgctggtgttggcgagtcttgtctgctacctgctgttcggattgttcccatccgcgttcggcacgcaggccgtcgccgattcgttcgggcccgtggatttcgtgaagcgcttcctcgcggatgacatcaacagcttctactggttcctgtactcaatcatctacctgtacatgatcacgccgctgctgtcgttggcggccgacgacaaacgactcatgcaatatctcatcgtggtggacttcgccatcgcgtggggagtgccgctgctggaacggttgggcgtggccgagcggtatctcgaatcgttgctgcattggccgttgtacatgtcgcaggacatgctgtacttcctgctcggctactatctcatccatcatgtcgaatggcgtgttccggcgtgggtgtggctgctggtcgccggtgccgccgcggcggtgatgttcggcacggcgttgtggacgaacgggtatttcagcggcggactgtctggcgaataccataactatgcggtcaacggttcgccggtgcgcgtggtggagtccgtggccgtgttcatgctgttgcgtgaatgcgagccgcgcctgcgcgcggtgccggaacgtgcacgcggattgatccgcgtactgtccggcgcggtactgggcgtatacctgttccacctgccggtcatcaactggctgacggcgaacgtgcacggtgcattcggcgacgcgctcgcccggtacccgctgctgcggctcgtcgtgatctacgcggtgacggtggtcatcgtgatcgcggtgaagcggcttatcgcagtggcgcgtaacgcgattcgccgctgagactcgtatgcgttggcgtttagtgccgtgcgctatgttgacgatgctgacggcgctgacgatgctaacggctgatgcgcggcaccgcaacggtggcgacgatggcgatgatcgacagcgcggacaccgcttccgcgatacgccacgagacgggctccacataggcgatgcgctcgtcgccggaatacgacttatggggcgctattgctgttttcgtgggtgggtttctccgttgagttgttgagggagtaagagaagagcgctttccgggtaggatgttttcgaccaagataaacaaacaaccgcaaagcgcctgatgaacaggatattcaaccggcttctcaacgtcaaaaacacggtggtcgaggacgcgtgcatcgtcgactcgccattgcgccccggacccgtcctcgaggtccatgtgcgcccacgtgcgggggcatgctccgatgctcccgctgcggaaggaggcgccgcgggtatgaccagggcggcggcgtgcggagctggtgtggccaggatttcggctgctggaggggtcaaattggtcgccgccatgccgcgcgtggactgcccgaagtgcggcgtcgtggtcgcccgggtgccgtgggcggaaccgggcagccggttcaccaaggatttcgaggcggagtgcgcgtggctgatgacggtcgcgaaccagaggacggtcagcggttcccttcatgtgtcgtggaggaccgccggcgccgtcgcccatcgggtcgcggaacgcgtcaaggcgtcgatgccctcgccgttcgacggactgcacgcgatcggcgtggacgagaccagccacaggaagggccacacgtacctgaccgtggtcgtcgaccatgagcggcatcgggtgacatgggatcacgacgggtacggcagggacgtgttcggcctgttcttccaggcgttgacgcccgaacagcgcgcctccatcaggctggtcaccggggacggggcccggtggatcgactcatgcgtcgaccggtggtgtccgaacgtcgaacgcgtgctcgacgggttccacatcgtcagctggatgagcgacgcgctcgacaaggtccgcaaacgcctgtggaaccaggcgcgccgcgacggcgacgagaaatccgtcaagcgcatgcgcggcgtcaaatacgccgtgttgaagaaccccggcgacctgaccgacagacagtccgaggccttcgggaacctgcaggacacggaccccaagggccagctctaccgcgcatggcaactcaaggaactattgaggaccctgctcaagcacccgctcgaacaggcccgggccgaactgaaccactgggtgttccgggcgtcccacagccgcatccccgagatcgtcgaactcgcgaagaaaatccgacgccgccggccggacatcctgcgcacgatccagctgggctactccaacgccaggctcgaggccttcaacaacagtcttcgatggcttgattcagctggtcgatagtggataggaactcaccgttgatatgcgtgtaggtggccacatggtccaggtagcctactgcctgcccggcggcgcctgcgagctcgcggattttaccgatgaggtcgtccatggtgtcgaggctgatgcgagatagggtaagactgtctagtagcagtcgcatttcggcagtggacaggaatgcatcaagataccagccgggttgtggattcttgcattcgatgccggcaaggtcgctttcggtgagatgcccgatatgtctgccgagaaattccgtggaggtcagctttttgagctggtttcgtatggtcttctcggtcggcagctcgcttggatcttccagctggtgtttacgggcaagctcatcgagtatttgccgcacggtcaggccatgcccaaagtaactgtgacgccacagcacctcgaagatttcgagggtggtgttccctgcataggatttgcgttgcgccggcttgtctgcatccatacattaaggctaccgcgcgcttcgtctaggatggaaacgttgggttgaaatacattcgctggaaaggaggctcgcccatgagcaaagggtatggtgtgtttggccatgttcccgataatgcggatgacgatggcctcctgccttatgaggatgatgattccggcgtttcctggggccatgcgttgcgtcgtcgcaatccttggaaaagaggagacgacgaagatgccgattacgacgacggtcgctatgacatagatgacactgatgacactaatgggggcaggggcatctatgccggtaaaagcggcggagtaggcggcatttctggtgagacgggtggaatacttggtagctcaggcgcggccggcagcagagacgtaacgtttggtggaacggacagtttgtccgccgccgatgcggtgatgccctatcgtctcaggcaaggacgttccgtatggttcgacgatgaggacgaaggccatttcgccgggtctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgaacttgacggtattctacgtggcaccaccagcccatcaagtaggtatcgcaccagcgtgcaattcgacctcgatacgggggaggaggtcggcggcaagtgctcatgcccggcttacggccgtggctatggcatgtgcaagcacatgattgcgctcgccttcatattctgcgatgatccgcagcgttttgaaggctaccgtgccggggctgtgaggccgtctcggacgctgattgactatatggagcacgccgataggcaagacgctcaagccaaaattcgtcgtcgcaatgcggttatgcgtcggtttgatgccacgcaagggaaaaacggtgcaaatgctcggcgtacaaaaagcggatacggctctcgtgccggcacccgaggcggcgggtatcagggtgacagcgagactgtgggcttggggcaggtgcagcttgtcccgatattgagtttcatcgacggcgtgtggagcgtggagttcaagatcggctcggcttccaatgggtccagctatgtgctgaaatcgattccgcaatttgtgcttgccatggcgaacggcgactatgcggattatgggcagaagcttgcctttactcatacgccggatatgcttgatgatgattcgcgcccactgctggacgtccttgatgatgcgatggccgtgcgtcgtgcggccgagcagcaggacaggtattacgggcatatcgccatcgaccgtcatctgacgctttcagcaccggaagtggcccggttgctgtccgtacgtgagggcagaggcgtacagctcgtgctgaacacatggttctccgggcagcctgcatcggtgccagttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccactaatccggccggtgcggtatccgccatgatggcgggctctcagcgtaaaagcgcagcaggatgccgattcgtccgttgcccgaaacgattgattccgttgcgaggactattgggagacctgtttgaacccgatggcgaggggcaggtcattgccggcgatgacatcgccctattcgcacgcacgctattgcctcagctggttggtgctggactgttggaggccagtgagattcctcgcgagctggctgaattaagccctacggaatgcagcctccagttttatctggatcgtgatgagcatggtgtgcaatgcgaggtcaaggcacgctacggcgatgccattgtcccgttgctacccgatggcccgacggtgcatgctgagggcgagcgttccatccccttgtctcggggcgtgattgggcgtgatttcgacgctgagcatcttgcgattgatgtagtgcgtgaattctttaccatgcctgaccagcgcaagcgcgttgcggccgccactcatcagacggtgaatgggttccgaacgccggccgcgcgaaaggccaccaaaaaattcgtgtctgatgcggccactatcgatcgcgatgacaccacgcagatcgttcgtctctttgacgagggattgccggcactaaaggaagtgggggaggtcttcaccacaccggcttttgaccggctgatcgcgcccaagccaccaagcgtcaaagtcggattgtccatcaaaggcaacttggtggagatatcacccctcgctgatgaagtgccgccggacgaagtgggtgccttgctatcttcgtaccgtcggcgtcaacgattccatcagttgaaggacggcacgcttgtcaaactcagcggcgcgaatctcagcacgttggaccgattggccagcgacctcgatctgagcgagcagcagctcaactccggactgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggctttcaatggctgaacacgttgtgcgacaagggttttggcggcattctggccgatgagatgggcttgggtaaatccgtgcagcttatcgcgttgctcctgtctcgatatcagcggaataccggcgagatgggcgacggcagccttggcccatcgctgatcgtgtgcccggcgtccttggtgtacaactggggtgccgaattcaccaagttcgccccgagcttcaatgccgtggtggtggccggtaccaaagccgagcgccgtaccgccatcggccgtgcgttccgggcggatgaacccaccgtgctcatcacctcatacgacctgctgcgccgagatgtcgatgattacaccgccaatgagcaacgtttcaatgtcatggcattggatgaagcccagtacatcaagaatcacaccacgaaaatagccaaagcggtcaaggccgtggccgccgaccatcgtttcgccttgaccggcacgccgatcgaaaaccgactctccgaactatggagcattttcgactttctgatgccggggctgctcggctcatataagcgattccatgagcgttatgagttgcccatctccaatgcccgggccgcggatggcagcacggctgaaggtcgggccgccgcacaagtcaatcctgaggccgctcgggtatctcgccaattgcagtcgttggtgggcgtgttcatcaagcgcaggctgaagtcccaggtgttgaccgatttgccggacaagctagagaccacgctgaccgtgcggcttgccggcgaacagcgcaaactgtatgcggctcacgagcagcggctcagaatgcagctcgaacacagcgaagaagccgatttcaacacgtcgaagattcgcattctcgccgagttgaccaagttgcgccagatctgctgcgacccgaggctgctgtacgccgatgccaaggatcaatcggccaagcttgccgtcatcaccgaactggtggaaacctgtgtgaacgaaggcaagaaggcgctgatcttctcccagttcaccagcttccttgatctgatcgccgaacgtttcgacgcgcaaggcctgcgctactacaccatcaccggctccacgcccaagaagaagcgtctcgaactcgtcgaccagttcaatgcggacgatacgcctgccttcctgatttccctgaaggccggcaacaccggactgaacctgaccggtgccagcgtggtcatccacgccgacccatggtggaacgccgccgcacaggatcaggccaccgaccgagcacatcgtatcggccagaccgaagacgtcaacgtgtatcaggtggtggccaaagacaccatcgaagaacgtatcttggagcttcagcatactaagagcgagctcgcccgccagttcaccgacgcttccttgcttgccgacgaagccggcaccggcgccagcgccctcaccgaagcccccgcctccatcgccaccctcaccaaggacgatctcctcaatctgctgggatgagaagattctgctcggtgctcttgagcttggggatggaaacagtctgggctttgtggacccgttcgctaagccgagaccggagtcgatagcggtgtggcatggttcgtgcgtggggagcgtgattcagttgttggctgaggcgattcggacgctgtcgttttgtgctttgttttgccgttgaccaattgaaatgctcgttggtaggagacccccaataaagctccgatttgtcgatacgtgagtccctcgttgcgtagggcctgtgcggcgagtcgggattcggcagccgcttgtgcgttggctttttttgctatttcgcgctgccggaacatttctgttacgtgttgtttggcttgtttcggcaacacaaacgtcaccttgagctccggattgtcgtcgtcgttcatgacagtgatgagatctttagccattggctcgatatcgtcaagtcctttggcctgggtcgaccgttcgatagctggtacctgaacgtaccaatatcggtcatcgggttgcacaagcacgtcatagttgctcattgccaccacccctttccgagtttctgctcgctctcgttgatgatatccagcgtggttcgttctgagacttcattatggcgggggatgggtatcctcaacccgtccaggcagtaaacctcatgtctgctgccttgccgtaacaaatagaaatcgagccctcgctgctttgccgcttgccgaagtttcttgatgatgagttttcttcgtgtcatcataactctcaatcccgcactagacaaaatgcgtatgtcgaattgccgggtgggagttgtgggtaaacgtagagatgttcattggtccttctttctgttgtctgacgcgtcgttgcgtgcgggtgcatttgacggtatgggatgaggtctctgattggcaagctgaacgggggtatgtggttctagcttccgagttatccacattgataaggtgcttttttaaagtgactttcccgtgttggtcgtggatgctgcgagcaaggcaagaacggttgatcacgtcgcgatgcgtgtgggtgaatggtgaaagtgtttttcgatatctttatatcgatattcgatatattatgatggtggcatacggtgctgtgcaggttcctccattgatattgatattggattaaggagcatagccatgaacgctggtatcgcattcatttctcgtaaatctcgcaaaacagacgtcgcttggcgctatgccattgccgtggtgcttgtcgtgtgttgtattgggctcgcatatgtggagattgttgtggcgccgtggtttatcaatgaggtggtgtctatgtttccggagaccacgttgcttaaagaaccgtccatgttctgggaatgggcgattctgctcgccgttcaggcgactttgctgtgcacggcggcgctacagcacctgctccatgccgatgtgatatggagtgagtcccatgtgttcgtagaaggcttgggctttggggttgcaggcccagacgttgagcgttacgttgtggcagccggattgacgggcgaagtcgagcacgtagcgatacaaggtggagcctacatggtggccgcgggaccgctcgtcaacgcatagatcatcgatgtacagggttttgatatcggtcaggatattgctgttgaggtgctgctggaacacgcagaatgcgtagccaagcacttggtcggtggcgggggagtcggcgttatgttcggcgtcattgccgtcattggcagatggcgcaaccgccacgaacacaggggtctgatcgttggccagaatcgccttcaattcctcgtccgtgtatttcttgacaccgcctttgaacagatccggtcggccggcatgatgcacttcgagcacctgccgcagcagttcgtcgatctggggaatatcggccgccgtggccctacgaatcgtcatgtcatccattgaactcagtctaatcgggcagtctcgaccggcagatgattgttgcccgcgataagagacacggacgggcaagatgggtgatcgttcgttcaggctctcattctcgccgcaacgtcacggtagtctggagtgcgtgaatcgcaagaaacagccagtggagaagtatgagcggggtacccgttcgtacacgatgtcgcatattcgtggcaaagacaccaaaattgaggtactggtacgcagctacctgtttcgcaaggggttgcgattccgcaagaacgacaagcgttaccccggacacccggatgtagtactgccgaaataccacgccatcgtgtttgtcaacggctgtttctggcacatgcatgaaggatgttccaaacattcgatgccgaaatcgaacgtggaattctggcaggcgaaactactgcgcaatcacaatcgagacatcgcgcagcgagccgaactggaggccgctggctggcgtgtaattaccgtatgggagtgcgaattaacgaaagccgtgcgcgacgaacgcctcgtacggctgtatgagcagattgttgaaggagatgcagattcagcggaataatttcagctcccctctggaggggagctgaaatcaggattcaaacgggaacttcaggccccaacggtcacgaatcgcatccatcagctccatgatgcggatggtgtcggcgtgcggcatcgcctcgcattcgatcttgccgtccagcagcgcgttggccgcatcggccacctcatactcataaccggtcaactgcggcggcaccgcaatgctgcgcacgggcttgtgggcgttgtcatagatgtcgatggactcgggattgttgatattggtgaccaccagataaccctcggtgccccacacatagccgccgcggtcggaggaaaccagcatcgaactggtggacacggccatcgtgccgtcgctgtaatacaacgtggtggaattctgcgcatccacaccggtttcggcgggcaccatcgacgtatcgaaatgatccagcgtgcggccatggtcggcaccgatcgccatatccaggaagttcagcggatacacgcccacatcgagcagcgcgccaccggcacaggccggatcggtcatacgtgccttgccggacaccggatagcacaggttggcgctcgccgctttcacctcgccgatctcgccggactcgataacttcgttgatgagcttgcggctgggcatgtagcgcgtccagatggcctccgtgcacagcatgccggtttcctcggccacggccagcgcctcacgtgcctgtccggcgttcgcggtgaacgacttctccaccagcacgttcttgccggctttcatacacaggatcgcctgttcggcgtgcagactgtgcggggtggcgatatacaccagatccacatccgggtccgccaccaactcctcatacgatccataagccttgtcaaaatgccattggtcggcaaaagcctgcgcgcgcgtaatatcacgggccgctaccgcatacgggtgaatccatgaggaatacagtgaatcttcagccatctgggtcagggtgccggccatggtgtgagctatgcggcccgcacccagaatcgcgacgttgattttttcgccgctggcctcgaactcggcgcgcttgccattgaatcgactcattattcctccttgaatgcgggttggtgcactcaatcgacctacagtgattatagaagaagaaaccttgtcccgtgaggcggatagaaccgaaatatggaaaacgaagcagcgcagcagccccaatctccggccgcgtctccagtcatgtcccgccgagcgcgtgaggccaatcccttccgtgccatggtattcggcgaacaagcagacaagatgatcgcccaaggtaccagcgtcatcaaattaagccttggcgagcccgatttcggcgcgccgcccgccgtacgcgacgccatgcgcgaacagtacgacggccgggccctgccgtacaccgccgccatgggcctacctgaactgcgtcaggccatcgccgacttctaccgcgagcgtcatgaccttggcatcgaccccaagcgtatctgcgtgaccgccggcggttcggccgctctgctgttggccaccgcgctgaccgtggaccccggtgacgatgtgattgtggccgacccctcctacccatgcaaccgcgaacttgtgcggtcgtttgaaggccgggtcatcgatgtgccgacctcggccgccacccgcttccacctgaccgccgacctgtgcagccagtactggacgagcaagaccaaggccgtaatgatcacgtcgccgtccaaccccaccggcaccaccatcgacttcaacgtattggacgaggtgtgcaagttggccgccagccgcggcgcatggcgcatcgtggacgaaacctacctcgacttggctgaccgggagccggacggtaccgaagtcaaatccgtgctggcctgcgaccccgatgccatcgtatgcaacagcttctccaagttcttcggcatgaccggctggcgcctcggctgggcgattctgccggacgagcccactgtgctggaagcggttgacgatctggccaccaactactacctgtgcgcccacacgcccacgcaacatgcggcgctcgcctgcttcacgccggaaagcttggcggaatgcgaagctcgtcgtcaggaattgctggcccgtcgccgcattgtgattgacgggctcaagcgcatcggtttgccggttgaggtggagccgaatggcgcgttctacgcctacttcgacatctcccgcactggtctggatgcctggacgttctgcgaacgcgcgctggatgaagcccatgtggctctgactcctggccgcgacttcggcgcggccacggcggatacgcatgtgcgcctgagctatgccgcctcacgtgaggccctgaccgaggggctggaacgtctcggaacgttcgtcgaatcgctgtgaacggcgcggcagccggtgtgattgttgtacagtagtcgagtttgtgtgatgttcggctggcctcacggtgttggttgccggccgaacgactcgccatggtggcgcacggctggctgattgcgatggtcggcccgttgttcggccatcacgggttaggtaaggtcaggaataggaatcatggtcaatctgcgttcgcataccacgcgacttggtgtgcttgatatcggttcgaacactatccacatgcttatcgtcgacgccgcccccggcgctcgccctgaccccgaggccagcaccaaatccacagtgcgcctgatgaagtatttaaaggacgacggctcaatcaagaagtccggcatcgaggcgattctggaagccgtgtcccagtgcatgcggctggccgaggaatacgaaatcacccagctgctggttatggccacctccgccctgcgcgaggcgccgaacggcaacaaagtgattcacaagatcgaggaactgattggtcagggcgtcactgtgctgtctggcacggatgaggctcgcctgaccttcctggccgcccgccgttggtatggttgggatgccggccgactgctggtgctggacatcggcggcggttcgctcgaagtggcgatgggctccgacgaagagccgaccgtagcgctttccgccccggctggcgcgggccgcgtcaccactgaatttctgccttccggcatggccacgcccgacgagttggaagacgtgcgtaagaacgtgcgcaagattctggagccgatggtcaaggttttcccgcaatccaagcacccgaatcatgcagttggcacctccaagaccttccgctcgctggctcgcctgtgcggtgcggtgatgcgtgcgccgggccgcgaagattcatggattatgactcgtgagcagttggaagactggattcctcgtttggcggcgatcgcgcctgagcagcgcgtggctttgcccggcatcacgcctgaacgcacgatgcagattgtgggcggcggcgtggtggccgacgagatcatgaaggccctgaatattcaggaagtcgagatctgcccgtgggcgctgcgtgaaggcgcgattttgcgctggctcgaccaattcggccgcacccgcctcggtttctagtcctattgaggggaatcacccaaccgccacggtagccaacaatgccgcatgatcagagccctcgactttgaccaccttgcattgtccggccttcatgccctgatcaagcaccacgtggtcaataccggcgaacattggcacagccgcacggttcgtgggccatgagaacgtaaacccatgtccggattcacgtgcggcatccacgaaccggtcgccaagaaaatcacggaatggcgtgtgatcgtaagtggcgttgaaatcgcccatgaaaatataccgtgtatccgtatgctcgcgcatcagacccaactcatccagcgatcgcttccactgccgccagtagccgggtacgggagcggtggtgtgcacggatacgaatcgaatctgctggccacccatatccaccgtgccgccgggcatgaatgaggcgctggaattcacgtcatcgtcggtcggatcggcaagtggcgtggccgaccagaggccgttaccgaatacgccgtcagacgatgagacctgcgcatacggcagataatgctcaataccagcctcattgagttttttgacgaaatcctcggtggtctcctgcaaagcaagcacttcgacgcgctgatcgcgaaccagctcgacgatggcttgcgggtcggcctgccccttatacacattgaaggtcatgacgcgcgcgtaggcatcgctggtgttgggggaggctgcggccacggcgttctgcgcggcttgggggagtggatcggtcgagtagaagaacggatattgccaatagccattgcatgcgattgcggcgatggcgattagtgcggcaaggatacgccgcgacacgatggccaacagcagggcaatcaagccaagcaacgtgaaccatggcgttgccgataccacaatcggcgcaaatggcagttcctgtaaatcggcaggcagcgcgcgggcggcagcgccggcaagggcaagaagcgcgaacatcgtggcgagaaaaccaagcagacgatgccgtttgtgtggcttcacggcagacttggatactgggcgtgccgtggctctggcagagcgtggcttggcagcggcgcgagctcgtacgcttgcgcctgtggtagtactccgtgcctttgccatgctgccctttcctccggcttgtttactgttactttgcttttcgtgcgatttgccactgtaccgtgtacggcttgtctttcagtgtcttttcgccgtgcgcaagagcagttcgcaccaaactggcacgaaagaccgggccatgacctgatgtcgggttcctccatgtggcttgctcaggttgccggatggcttgcgcaagctgccacgcgaacatgatgcgactgggcgtgtggccgtgtacaatgaaacgtcgttgcccgagtagctcagtggatagagcaccgctctcctaaagcgggtgtcgtcggttcgaatccgatctcgggcacttggcttcggaaacatgacggtatctcagcctctattcatcggtgatgagccatgggcattaggcatgtgtaaacgtataggttccactatccatcatcccgtcgtgtgaaactatgcaaagacatgtggggcttcacggttgtcgtgagggtccatggctatcgaatacacggaagagaagcggtttactgttgagcaggttgaggcgctgttcaagtcggtaggttgggaatcggcgcagtggccggaacggttgttcaaggcattgcagcattcggatacggtgatcagcgcatgggatggcggccatttggtcggcttggttcgcgtgctcgacgataccgaaatggtggcctatatgcattgggtgctggtagatccggcatatcacgggcagcatatcggcagccatctcgttgaactggtcaaggctaagtatcgcgactacttcttgctggaagtcatgcctgaggaaagcaaaaacgcaccgttctaccagaagcatggcttccacctgatggacgatggccgcgccatgcaaatcgtcaatcgcggctgacgggctggcagtgcggacggcgcaagagcggcggcatgcgccaatcgtgggcaacgtacgtagtcgttgacggttatcccgtagcaatgttcacaatacgaccccttgtccatacagtgaaaataacggctgacgttcgacgttgctgcgctatgactagagaccatgagtgaagacaaacagtatgacttctatgtggccggtccgttctttgatcctgaacaaacggcaagtatggaacgtttggaaaagatattggaagaccatggcaaggtactgttcaagccgcggtttgtcagccagatcgaagaagtaggccctgaaggatgctttgcggacgatatccatggcattaatgctgctaaagccgtggtcgccaatcttatggacgaggacccgggcacgatgttcgaaatcggatatgcgcatgcgctgggaatcccggtgtacggctatttcgaaaaccttacgccaatggatcgtgtcaatctgatgattgcgcaagcggtcgaactggtgttcgtcggtcctgatgatgtggcgaaatacttggaaaccggcgagcatacggaagtcgattacatccagttctaaacagctctaacaggttctctgcaagcagggttggcggcgttctcgtacatagtcatgtacgggaacgccgcagtggtatagggatattccaacaagcggcataatggggtcgtgggaaaaccagtcggatacaagtgaagtgtctgaatttcgtaaggagtgccgttatgagtaaccacaatcccatgaatattgccaccgactttgccaaggccacgggaggaaccgctcgcaaagttgttgctttgaccgataaaggtccgttgaatggctttaagaaattcctgtcgcgcggatcgatgattgatatggcggtaggtgtggtgatgggctctgccgttaccgctgtggtcaattccatcgtcgacaatctcatcagtccattaatcggcatgattggcggcgtaccggatctttccggactgctgaccatcacgttcaacaactcgactgtttcatttggtgcgattcttaacgcgctgattaacttcctgcttgttggcgtggcggtgtatttctgcgtgattttgccgattaataagcttcgtgatctcactgctgcccaggatgaggctgacgctgaagaacaggggcctagcgttgaagagcagactctcgccacgctgcaggagattcgcgacgagctgaaaaaggccaataactccgccgagtaatctgctgaatgtacggtgcgacagatttacctggtttgcccgaaataacggattgccggggccatttggtctggacaatccgttgtttcgcgcgtgttttgtagcatccgtggagttgcatggggagtatgactgaaaacatcgctgataaggccataaacgatactcgtatcgtcaagcagttcaccaatcccgtcaaggagccgattgacagcgacatcaacctgttcgatctgctcgataaccgcgccaagcgcgatcccgaaggtgccatgatcgaatacaagggcgatgatggcacttggcacccgtacagcgcccaagtattccgtgacatggtcatcgacttggccaagggcctggtcggacttggtgtcaacaagggcgattcagtcgccatcgtctcgcgcacccgctgggaatggaccgcgctggatatggcgatcatgtccatcggcgcgctcaccgtgccggtgtacgagaccaactccgccagccaggtcagctggattttcaacgattccaaagtcacgctcgccatcgccgaagatgacgggcagcgtgacaagatcgaatccgtgcgcgatgaggtgcccaccctgcgcaacgtgttcgtaatcgaggccggcggtctgaacgccatcaagacctacggcgaaagcgtcaccgacgccgaattctgggaatacaaggaagcctcccacggcgacgaccgcgccaccatcgtctacacatccggctctacaggcaccccgaagggcgtggaactgacccaccgcaacttcgccttcctggtgctttccgcgctgcagtacatgcctcgtgccggcgcatggcccaaccgccgtctgctgctgttcctgcccctgagccatgtgttcgcccgattcctggaattcttcagttttggcggcacgatttcgctggccttgagctccaatatgaagacgatggtcaaggacttcgagaccttcggtcccacgctgctgctcgccgtgccgcgtgtgtacgagaaggtctacaacgccgcctcccagcgcgccggcaccggattcgctggcaagatgttcatgcgcgccgccgaaaacgcgcgcgaatggtccaaggccgagcagaagggcgaacagctgccgattgccggacgtatcgcccacgccttctatgagcaggtggtgtacaagaagattcgcacgattttcggtccgaacgccgacttcgccattaccggcggtgccccgatggactctgagctttcccacttcttcaacggcatcggcatgccggtgctggaaggctacggcatgaccgaaacctgcggcccggtgtgtgtgagcttgccagaggacaaccgcatcggcaccatcggcatgccgatgtgcggtatcaccgccggcattgccgaggacggcgagctggtggtcaaaggaccgctggtgtgcaagggctaccacaacaaccctggggtcactgcccagcagatcactgatggctggctgcacaccggcgatctgggcgatatctccgaagatggcttcatctccatcaccggccgtaagaaagacctcatcatcaccgctggtggcaagaatgtgtcgccgggtctgcttgaggcttccgtgatgacctcgcctgtggtcaaccagtgcttggttattggtgataagaagccgttcgtggccgctctggtcacgctggatctggcggatgccaacaattggctggaatcccagggcgccaaaccggaacccgatctggcctcgctggccaagaacgccatcgttcacgctgaggtggagcgtgcggtgaacgccgccaacgagggcgtttcccgcgccgagtcgattcgtaagttcgagattctgccagacgaattcaccgaggccaacggcatgctgaccccgagcctgaagacccgtcgcgcgcaaatcgttgagcactatcgcgagctcattgacgacgtgatctacgtgccgttgaagaagtagctatcaactccctctgatccaaaaaataagctctctctgacgagggaactgtcagccgcaggctgactgggagagaccgcggctagcccgcgaaacaacaaggccgggtgcgacttgcacccggcctcagcttattcagtccaaaatcgccgaaacataatcggcggcggcctgatccagctccgcatcgccgatggtggcggtgccctgcaccaggaacggctcagcatagttcatgccgaccttgtacgccacgacctcaaacgggcttagcagctcctccatggtgtggctgtactcgccgtccttgcggtacttggcggcgtcggaaccagtggtgaccaccagtttgagctccttgcccttcaacgcatgggctccggcgtaggcccagccggcggtgatgacctcgtcttcccattccttgagtagcgcgggggaggagtaccagtagaacgggaactgaaggattacgcggtcggcagcctccagcagctcgtgctctgtgtcggcgttgacggagaagttcgggtattcggcgtattcgtcgcgcacgatgatgtcgtcctcgccctgtgcggtgagttcggcgagcaggcgggcgttcacgcgcgagccgtccttaagatgcggatggaatacaagaatcaacgttgacatgggatttcccttctataaactgctgccaatgtggcctaatcaccactatcgtatgccgggaagcagaactcagtccagtccggactcaggtgcgagccgcgggatgccgcgccgggaggcaactcagtcgaggttggactgcgtgcctgcggtggcttcgttggcggcttgctcggcttgtgcttggtcgagcttggcacggacgtcgttgagcagaccctgggcgcgcttagccaaggcctcgccgatctcccattgacgcatcgactggtcaagattgaggccgccggtttccagtgcctggacagcctgaatcagcttgtcgcgcgcctcctcatatggcatctgggcgatgagctcgcgttccttgtccgtcagggacgtggcgggggtgttcatgtcggtggatgtggcgttttcggtcatgatgttctccttatatatacggtatatatgcgtggctgcgtatggcgtgtcacgcggttgcggatgtggtggttgcggtaatgacacccttcttcaaggtgacggtgatgccatccccagggcttacctgcgaagcatcgtctagtacgtggccatcggcggactgcaccaccgcatagcctcggttcaacgtggattgcgggctgagtgcggtcagtgaggcgtgagctcgctcgacggtgagctgggcatcgtccacgatgcgtcgcagcccgatatcgagccgttgcaacgagtcgtcaattaagcgctgatgaggctcaagcatggtgtgcggctgtgtcaggctcgggcggttcgcatatccctcgataagtcgaatctcgttctccacgcgcgaacggacccgcagtcgcatacggtcgatggcaccttcgatgagctgcgactgctcacgcacatccggcaccacgcgcttggccgcatcggtaggggtggaggcgcgcagatcggcgaccagatccagcaatgtccagtcatcctcatgcccgatggaggagattaatggtgtagtgcaggcatacgccgcacgaaccacacgctcatccgagaaaccgatgagatcctcaaacgagccgccgccacgggccacgatgatcacatccacgctcgggtcggcatcgagttgtgcaatggcctgaaccacctcggccgggcattgctcgccctgaacatgcacatggaccaccttgaaggttacggaaggccaacgaaggttcacattggtgatcacatcgccttccgcacgtgcctgaggtgcgcaaatcaggccaatagtcttcggaaactccgggagaggcagtttgtgatcggcatcgaacaggccctcgcccttaagctgcttgcgcaattcgtcgatcatggccttgaggctgccaccggctccgaccttgagaatcgtgtccccgcgcaacgacagcgaagtgcgcttcatccacaggttcggtttgccgtgaatcaccacgcggtcgccctgaacgaactggctggctgcggccgcgaacctgccgaagccattgacttccatggcgatatcctcgaagtcgtcgcgcagcgtgatgtaggccgagccggcgcgacgggtattgatctgcgtgatctggccggtgacccacgcggacggccatcgttccacggcaccgtagaacttctggctcagcacgcttaccggccacggattttgcgcggtggtttcagcggcgcgtgcaggcagctgatcgatagggcgaggctcattcggcagattgatggcgccccgatcgggcgcgaaagtgccttgacccggctcaaagccagacgaggccagtgaagcggcggtcggtggacggccggtagatgagtagcccattgcagtagtcatgcactccactataagtgcgttggttgatgacggtaaaaatttaccgtcgcctgaaaacggtgtgatgatgaatgcaagaaccgtacgaagcgatgtatcagccgatgatggagatggtctggtgcatcagaagaaaggagtcattatggcgaagaaacgggtgctatgaagaggagtgagatatgcgttgcactgacgattgagagtcgtcagtgagctcgctgtgcgacacgcgagcagaaaacagttacgctaatcacacacttgtagttttggcgaaaaatagccgaaaaaccctataaatagttcgacacaccactgttgagcactagatataggggtggggatgccgtattcttctagaggttcaagaaaacgatatcaatgtaatttcgtgtggcccacgtcgagtgcggccaaaatgcggaactcaggagagtgttcgccttataggaaaggggtgcccgatgggcgcacaggtgctggaggaaaccgtcaccgataacgagaccaaggtggccgccaaggcctccaccgtgctcgttgagaagcgtgatggtcgtgtggtcgacttcgaccccatcaacatcatctctgcggtcaagtctgctttcggcgacctgaacaaggaagtcggccccgaagaagatgccatgatccgtggtttcgccaaccaagtcgaaggcgaaatcaaggggcgttacaccggccccgccaaaatcgaggacatccagaatctcgtggagcacgccctcattgacgcccacctgtacgatgtggctcgcgcctacaccaattaccgtctcgacaaagacattcagcgtgccaaggccactgatgtcaacgaggccgttgctcgcttcattaatcatgacccgaccctgattcacgagaacgcgaacaaggattccaacgtctactccacccagcgtgatctgctggccggtgccgtgtccaaggccgccgcgttcaacatgctgccgccggcggtgtccaacgcccacatgaagggcgacattcacttccacgatgccgactattcgccgttcactgcccagtccaactgctccttgccgaacttctgggacatgttggccaatggcttcactcttggcaacgctccgatggcttccccgaagtccatcgccattgcggccacccagattacccagatcatgaaggacgtggcctccagccagtatggtggccagaccgccaaccgtgccgacgagcatcttgcccagtatgccaagaaggattacgagaagttccttgaggaagctcgtgagaccatccccgacggcatgccggttgaattcgcccgtcgtcaggtcgagagcgccaagaagaacgagcccgccaagctgcatttcggttcccgtgaaccgctgccgatggacaccccgttccacaccgacgttgacgaacttgagcaagagcgtgaaatcctcgccaagattcgtacccgcaaggccatctatgatgccatgcagaccatggaataccagatcaactccaaccgtgtgtccaacggccagaccccgttcgtgactgtcggctttggtctcggcaccgactggttctctcgtgaagtgcagcgcgcaatcctgctgaaccgtattcgcggcctcggcaaggaacaccacaccgccatcttcccgaagctcgtctttactgtgaagcacggcgtgaacgccgacccgggtgacccgaactacgatctgaagcagcttgccctcgagtccgccaccaagcgcatgtacccggatgtggtgttctacgagaacatcgtcaagatcacaggctccttcaaggctccgatgggttgccgctccttcctgcagggttggatcaacccggagaccggcaaggatgaagaagacggccgtatgaacctcggcgtggtcaccgtcaacgtgccgcgtatcgccatcgaatcccacggtgacaaggctcgcttctggaagctgttcgacgagcgtatggaagtcgcccatcaggccctccagttccgcatcatgcgctgcaaggaagccaccccggtcaacgccccgaccctgttccgctttggtgcgtttggtcgtcttggtgccaacgacaacgtggaccagctgttcaagaacgagcgtgccaccgtgtcgctcggctacatcggccttgccgagaccactgcggtcttctatggcaagaactggattcgcgaccacggctgggatccggaaggcaaggagttcgcgctgtccatcgtcaagcgcatgaacgagctgtgcaagcagtggagcaaagcggagggttaccactattccgtgtactccactccggctgaatccctgaccgaccgcttcaaccgcatggaccgtgaaaagttcggccgtatcgaaggcgtgactgatcacgacttctacaccaactccttccactacccggtgtggttgcagcccactccgatggagaagctcagctacgagaaggacttcccgtactacgcttccggcggcttcatcaactactgcgagtacccgtgcctgcaggacaacccgaaggcgctcgaagccgtgtgggattacgcctacaacatcggcatcggctacctgggtaccaacaccccgatcgaccactgcttcgtgtgcggcttccagggcgacttcgagccgaccgaggaaggcttcaagtgcccggagtgcggtaactccaacccggacaagtgcaacgtcaccaagcgcacctgcggctatctcggcagcccggtccagcgcccgatggtgcacggccgtcacgaggaaattgcccaccgagtcaagcacatgagcggcgaaaccggtcgtgtgacgctggatgacggaaccactcgcgagtggttcgaagagaccaagtagggtttatacttgctcccgctgacgggagctgtagagcgtaagcgagactgagggcggtcatcctttatggtgttgaccaccctcagtccgtctgatgacggacagctcccgccagcgggagctaatgctttccgtaaggagggaatcatgccggagctgcatacgaccaagcccgaacccaagcgccatgactttgcggccggcgagaccgggcgtggcccctccgtaccctccaacggtcttgccaacgatccgaaagccggtcaatgggatggccggcgcatgtccaagcggatgatcgccgactacaaaaccttcattgtcaccgacggagaaggcgtgcgcaactccctttacgtctccggttgccccttccactgcgtcgactgcttcaacgcctccatctgggatttccaagccggccacgaatacacgcaaaaacttgaagacaaaatcatcgaagatctgaaagccccatgggtgcaaggcattacgttccttggcggcgagccattcctcaacactcccgtgctggtgccgctcgcacaacgtatccgccaggaattcggtcataccaaagatatctggtcgtggaccggctacacatgggaagaactcatgcgccccggagaaaccccagacaagcttgaattgctacatctcatcgacattctcgtcgacggccgctacctcagagaccagaaggactcgctgctgcaattccgcggctccagaaaccagcgcatcctcgatgtgcccaagtctctggaagccggcgaaccggtcatctgggccaagctccacgatcaagaacgagatatccccgaaatctatttgaaagaccgcgaagccggcgaaggccaacaggcctcgtagtagcagttctggaatgccgcactcagcaatatcgttggaactgttgggaaaaggccttcccgtgagcgaaatcgcctcgcctcgtgccatgttgggcaggtggtcggactaatattccataagaagtagccgggcgaagccgtccgcagggtatctgccagccgtcccgaaacggttcatgatgcctcaaagcgtgcactcccggaagtcggaattaagaggaacacatggttgacatcgccactgacgcgagcgtaaagcccgcttcacacccgaagcccctgcgtgtgggattggacatcggttccaccaccgtcaaggccgtggtgcttgatcagtccgattccctgggagacaccctcttctccgattaccgacgccaccacgccaacgtgcgtgccaccgtggccggcctgttggtcgacatccacaagaagcttgtggacctcggacgcggcgatgaaccgattcgcctgtctatcaccggttccggcggtctggcgcttgctgacaatctgcatgtgcctttcattcaggaggtcatcgccgaaaccgaggcaatcgacaaggaatacccgcaggccgatgtcatcatcgagctcggcggcgaggacgccaaaatcacctacctgaaacccacgcccgaacagcgcatgaacggttcgtgcgcaggtggtaccggcgcgttcattgaccagatgtccacgctgcttgacaccgacgccgcaggcctcaacgagatggccaagagctacgagaacctgtatccgatcgcctcgcgttgcggcgtgttcgccaaaaccgatctgcagccgctgatcaacgacggcgcggccaagcctgatctcgccgcctccatcttcaccgcagtggccacgcagaccatcgccggcctggcttctggccgcccgatccacggtaccgtcatctttctcggcggcccgctgttcttcatgtccgaactgcgcgccgccttccagcgtgcccttgaaggcaaggtcgacgagttcatcgtgccgaccgacgcccacctgtatgtggcctacggttcggcattgcaggccgacatggattccgacgatcagggccaccatttcgaggcctacacctgcgacgaaatcctgaagcgtttggacgagctgaagaacctgccctccaacacgcccaccatgccgccgctgttccccaccgaggccgaccgcgaggacttcaacaagcgccaccataaggaacacatccacatcggcaccctcgaaggcgcgcatggcccgcacttcctgggcatcgacgccggttccaccaccatcaaggccacgctcgtcaacgacgaccgtgaaatcgtctggtccagctacgctaacaacgaaggcagcccgctgaccgccgccatcaacatcgtcaagaagatccaatccgagctgcccaaaggcgcatggatcgcacgctcctgcgccaccggttacggcgaaggcctcatcaccaccggcctgcacctggacgagggcgtggtggagaccatggcccactatcgtggtgccgaaatggtcagccccggcgtcaccgccgtcatcgacatcggcggccaggacatgaaatatctggccatcaccgacggcgtcatcgactcgatcgccgtcaacgaagcctgctcgtccggctgcggctcgttcctgcagaccttcgccatgtctatggggctgacgattcaggaattcacgcaaaaggctttggcatccacccatccggtggaccttggctcgcgttgcactgtgttcatgaactcctcggtcaagcaggcgcagaaggaaggcgcgtccatcgaggacatcgccgcagggctgtgctactccgtggtgcgtaacgccttgtacaaggtcatcaagctgcgtgattccggcgaactcggcgacactgtggtggtccagggcggtacgttcctcaacgacgccgtgctgcgcgccttcgagctgctcaccgaacgtcaggtcacccgcccgaacatcgccggcctcatgggcgcgttcggcgccgccctgaccgcccgcatgcactatcaggatgaggccgaccacttggatgtggtggttaaggccgatgggtccgaggaacagtccgaggctgagcccgcactcaagtccgaacccaaggccgcagccttcaagaagaccgagccggccaagcccgaagtccatgtcgttgtcgtggacggtgtgacccacaccgccagctccatcctgaccggcgacgcactcgacaatatgagcatgaccaccgagcgtgacgtgtgcaagctgtgccagaaccactgcaagctcaccatcaccacgttctctgatggttcgcgcttcgtgaccggtaaccgttgcgaacgcggtggtgacgccaagaagaagcgttccgaccgtccgaacctgtacgactacaagtacaagcgttgcttcgcctaccgccgtttgaccgacaagaaggccactcgtggcgagatcggcattccgcgcgccctcaacatgtacgagaactatccgttctggttcacgctgctcacctcgttgggcttcaaggtgatgatttccggccgtagctcccatgaactgttcgagaccggcatcgaatccatcgcttccgaaaacatctgctacccggccaagctggtccacggccatatcaagtggctaatcaacaagggcatcaagaccatcttctacccgtgcgtgagctacgaggagaacctcgtgcccaacacggacaatcattacaactgcccggttgtggccaactatccgctcgtcgtcggcgctaacatgcctgagctgcgcgaggatgacgtgcgttacatgcacccgtacttcaaccttgccaaccatgagctcatggttgaccgcatcgtcgaagagtttgcgtgggccaacgtgacccgcgaagaggccgaaaccgcggtcaaggccgcctatgccgaagacaaggtcttcaagcatgacgtgcagcaggaaggtttgaccgcgcttgcctatatgaaagagcacaactgccgaggcatcgtgctcgccggccgtccctaccacatcgaccccgaaatcaaccacggcatccccgaaaccatctgctcgctcggcatggtggtgctctccgaggattccatctgcgaattgcagccgggggagaagctcaacctcaccgaatttctttccgagggcgaggccgatccgcgtttcaagaacgccgccggattccgccacgtgggagaccgcacggtcaccaagatgccgctgcgcgtcaccaaccagtgggcctaccactcccgcctgtacgcggccgcacacttcgtggcctcgtatccgggcctcgagcttgtgcagctcaattccttcggttgcggcctcgacgccatcaccactgatcaggtggccgagattctggccgacaaggcggacgtgtacacactgctgaagatcgacgaggtctccaacctgggtgcagccaagattcgactgcgctcgctcaaggccgccgtcgaggaacgcgaggccaacaaggcccgcgaggccgctgcggccaaggctttggaagaccagcaggccgccgccgaacgtgccgctgaagaagccaaggtcaaggccgagtccgatctggaggctgccaaggccgtacttgctgaagcgcaggccgccgttgaagccgcgcagaagaaggtcgatgctgaggccaaggctgtgcaggacgccgccaagacggcacaatctgcacagtctgcgtccgtacagggtcccaagcccaccggcttccgcaggaccggttccaccgcgccgactccaggccgtcagattctgctcgatacgaccatggccgccaacccgaagctcaccaagtcgatgcgtgaggcctccaagcgtgccgccgaacgcgacctacaggccgcagtcgcccacaagaatggcacttcggacggcaccaccggcgtggcgaacgccaagaatgccaagaagtccggccacaacaacgccaccatgtcccgatacgcgcatcgtgagaagttcgtcaaggacatgaagaagaactatacgattgttggccctcagatgagcccgattcatatgtccttggtcgaagcggtgattcgttccggtgggtacaagttcgacatcctgaagcacgcgagccgtggcgatgtggaaaccggcctcaaatacgtgaacaatgacgcctgctacccggccatcatggtcgtcggccagctcatcgacgcgattctggaaggcaaatacgatcccgaccatgtagcgctcgccatcacccagaccggcggcatgtgccgtgcgaccaactacttcggcctgatccgcaaggctttggtcgatgccggctatccgcagattccgattatcgccatttctacccagggcctcgaagataaccccggcttcaaggccaccccgcccctgctgcaccgtgccatcaaggcgctgattctgggcgacttgctcatgaagtgcctctaccgcgtacgcccgtatgaggtggagaaaggttcggccaacaagctgtacgagctgtgggacaccatcgtgcgtgagaccatcgagcatcacggctattccaagaccgcagccaagacgccgagcatcaagaagggctatctgccgtataacgtgctggccaaggagatcgtgaaatcctttgatgcattgccgctgcgtgatattccgcgcaaggtgcgtgtcggcgtggtcggcgagattcttgtcaagtaccagccggacgcgaacaaccatgtggtcgacgtcatcgaatcccaggattgcgaggccgtagtgcccggcatcatggaattcatgaccacccgcccctacatcaccgactggaatgagaagaacctcggtatgggtggtaacaagacgctctacgccttgatgcgcaagggtcttgacctgtacaacgcgcctatcaaggccgcactggccacctcgcacggcaagttcaagcaggacgagccgatgcccgatcttgtcaagaaggctgctgaagtcacctccatcggtgtacaggccggcgagggctggctgctgactgctgagattctggagcttatcgaacagggttgcccgaatgtgatttgtgcgcagccgtttgcctgcctgcccaaccatgtgaccggccgtggcatgttcggcaagattcgtcgtctgcatccggaagccaacatcgtctccatcgattacgatccgggtgcctccgaggccaatcagctcaaccgtatcaagctgatgattgccgctgccaagaaggcccacaacgccaagttcgccgagaccggcgagccgcagggcttcacctccgcggactgaacgcacatacacttaagctcccctctatgaggggagctgtcgcgcagcgactgagggggagtctctagagcgagaaaccgggccggagcctgctatcggtttttcgtatagcgtattgcgggctttcgggcacgcgcgccggccggctcgaatacgatacaaagcatggttactccccgaatcagttacgcgcacctactcgccaagccgaaccccaagcatgtcgagagcctgctcaagttctttgagaacggtcgctcccagcgtggcaccggtggcttcggtgtggagatcgagcacctgcccgtgcacaacagcgacgacactgccgtaagctactacgagccgaatggcatcgaggcattgctcaaacgcttggctccgtactacgacgaggagaaggaatactgggagaacggccatctggtgggtctcggtcgttccggcgtcgccgtttctctcgagcccggcggacaggtggaaacctcaatcggcattttgaagaagccgagcgacctaaatacgctgtactccaagttccgtcgcgagctcgacccgattcttgacgatctcgacttccgcttggtcaactatggttaccagcccaaaaccagctttgcggatgtgccggtcaaccccaaggatcgctacgatgcaatgaccgactacctcggccgcgtgggtcagtttggcccctgcatgatgcgttgctccgcctccactcaggtcagcattgattatgtggatgagcgcgactccatcgaaaagttgcgtctgggcacggttatcggtccgattctggcctacttcttccgtaacaccccgtattttgagggcgagacgaacccatggccgctgctgcgccagcgtatgtgggattatctggacttccagcgcaccaatgtgctgcccggcctgttcgatgatcgctatggttgggaggattacgccatcgacgtgctgtccacgccgcttatgttcgctgacctgacccatacccctgaagctgtggcttctggagcaagccccaaggaactgcatcgcccgtcgttccgtgagaacgcgggggaggtgtacccagaccgcgaactcaacccgtacgagatcaaccacatcatctccacgcacttcaatgacgtacgtctgaagaacttcatcgaactgcgtcactgggattcactgcctatcgagcgtgccgagcgtctgacggagattgtgtcctctctgttctacgtgcctgagcaccgtgaacgtctggaaagctacttcgagggcatcagcgaggaagaggtgttcgaggccaaggccaacattcaggcccacggtcgcgaggcttcgccatacggccagccgctcgatttctggaaggaattcttgggattggagggcctcttgtccgacattcccggcgatctgaagcaccccgacgtgttccaggagtaagcgaagaagcatatacagaaaaaactattgcgcgatatcggtgtcgaaggcatgacagaatgttttgttttggcaccgttttgcatatccggccaaggatattggatgtggttgcgcatgggagtggggagaatgcggatagactggcggatatgacagctgggaattcattgcagcataagcgtgttcgcaagtcgccgggggaacgccggcaggaaattctcgatgccgccgtgcgactgatttccgagcgtggctacaacggtacttctgtgcaggatgtggccgatgcggtcggtgttaccaagcagggagttttgcgatattttcctagcaaagataacctgcttgccgcggtgtatcacgagaattacaacacgtttggcagtgtggaagacttcatggcctccggcctgcctggttcagggcccgatgatttcagattgcccgcatatctgaggttcttggtacattgcaattccacgcgccccatgcttgttcagctgttctcgatattgcaggtcgaatcgttcaatcctgcgcatccgttacatgacgagtttgccaatcgtcgggattcaatatggcaatactattcgacatacaactggaacctgccttccgaattcacttcgtttgaggagatccggcccacgttgcgccatgctctggagatcatggatggtgtgcaactgaggtggttacgggggccggccattgacttatgcgatgaatgggccgatctggagccggcgatatttccttcgccgatatgggacgggtatcgctgattcgctgtgtgccttgaaccgaggcttgtgcttgatagcggcagtaagtatgcgggcgaacgaagggggcgcgtacatacggtcgttttggtgtatgtgatgcgcgcggcataagcgtgttgtatgctgtcaatagataaactaccaattggtaattaaaaagctgttcgatttcactgaggaaagcgacttcgtatgaccgacaacactacgcctgccgcaactgctgaaaccttaccgtacaagaatcctgatttgctcgctggtgagcgaatcgccgacttgctctctcgtatgacccttgaagagaaggtcggccagatgatgcagcttgacgcccgcggcggcgatcttgaggatctcatcgtgaataagcatgtcggatccattctgcataccagccccgaggatttatctcgtgccgccaagaccgtcaatgagaagacgcgtctgggcatcccgttgattatcggagatgactgcatccatggatactccttctggccgggcgccactattttcccgtcccagctcggcatggctgtcagctgggatccggacaaggtcaaggccgccggccgtgctaccgccgaggaggtctcttgtaccggtgtacattggacgttttctcctgtgttgtgcatcgcccgagatacccgttggggggcgtgtggatgagactttcggcgaagacccgatgctgatcggcgaactcgcctccgccatggtcaagggctatcaaggcggtgccaaggccggtgaggaactgccaaagaacgcaatcctggcctgcgccaaacatttcgccggctattccgaaacccaaggcggccgcgacgcctccgaagcggacctctcccaccgcaagctcgaatcctggttcctgccgccgttcgagcgcgtggccaaagaaggttgcggtacgttcatgctgggttacgagtccattgaaggcgtgccggtcacattcaacaaatggttgctgaccgacaagttgcgcggcgcatggaagtacaacggcacgctgatcaccgattgggacaacgtcggccgctccgtatgggagcagcacgtcaagcccgattacgtgcacgccgcagccgacgcggtcaaggccggcaacgacctggttatgaccaccccgcagttctacgaaggcgccatcgaggccgtgaagaccggccttctagacgaatcgctgatcgacgatgccgtttcgcgcatcctggccctgaagttccgcctcggcctgttcgaggacccgcgcctgccggacgccgaacgcatcaaggcggtcatcggttccgccgaacaccagcagaccaacctggaactcgcccgcgaatccgtcgccctgctgcgcaacgacggcaccctgccgttcgccgagaacacggccaagcgcatcgccgtggtaggtccgctcgctgacgacgcccagaaccagctcggcgactggaccggcaactccggtcaggtttcctggatgccggacggccagccgcgcgacatgatcgccaccgtgctcgacggcctgatccagctcgccgccgacgattgcgaggtcgtctactcgcgcggcgcgaacgtcatcgacctcgtgcccgaccccgcaggcgagttctacccggacggccagccccgcccgaagatcggcgtctccgccgccgtggaccaggccctgatcgacgaggccgtggccaacgcccgccagtccgatctgatcgtggccgtggtcggcgacgtggtccagctggtcggcgaaacctgctccaccgccacgctcgaactgctcggtggccagaacgccctgctcgacgcgctcgccgccgtctcgcgcgaaaccggcaagccgatggtcaccgtgctcatcagctccaagccgcaggtgttgcccgcctccatcgtgggcgagtccagtgtattcgccaagcgcgtcaacgaccccgaaaccggcaccggttctatcctgtgggcgccgaacccgggcatgcgcggcggccaggccatcgccgaaatcatctttggcctgaccaacccgtcgggccgactgccgatcaccttcccacgccacgcgggccagctgccggtctactacaaccagattcgcggccagcacggcgaccggtacgccgacctcacccaagatccggcgttcgcgttcggcgaaggcctgagctacacgacgttcgcatacggcgaaccgaccatcgtgggcggcgcaagcaatgccgacggcacctttgccgaaaccgacactgtacgcgccgaaatcaccctcaccaacaccggcgagcgcgccggcgtggagatcgtgcaggcctacatcggcgacatcgtgacctcctacagctggaccgaccgcgaattgaaggcgttccagcgcgtcgcactggagcccggcgagaccaagaccgtcgccttcgagatcccggtggcgaactgcacgatcgtggacccggacgccaaccgcatcgtcgagcccggcgaattcgaactgctcatcggccactcctcgcgccgtgaagacctgaagcgcaccactttcaccgtggcgtagatgagtcaggcaacggctcggtaatggcaaagcgggatgcggctcgatgtcgcatcccgcttttcggcttgttgcgctgttgcgttgccgccggccggcgtcaatcggacgtggtgatgtgctccacatcccagcgcacgccgagcacttcgggcgcgcaactggcgttcgagccctatcagtgcgcccaatgccgtgccaagcacgatgcgtacggtgcagtcgagaataacggccagagaaaacgtggtgaacatgaggattcacctcctgaaaaaaggcgtcaggaacttcccgcacaccctacagcgccagcccgcctcccgcaactgcgtcgccgcgttcgggtggttcgggctccgtgcggtgagcgggccgcggccgtatgatggaagcgcgggtagtccgggattttctgcatacggcgggaggcgtcatggttcctattgagaacgtgtacgaacagattcgtacgttcgccgctgatgccggcgctcgcaaggtcgtgctgttcggttctcgcgcaaagggtgtgaaccggcctaaaagcgatatcgatcttgccgtggccggttgccccgatttcaatcgcttggagcagaaccttcaggacaatctgtggtcactgcttaaagttgatgtcatcaatctggatgagccgatttcttcatcgctgagggcggagattgagcgtagcggaaaggtattgtatgaaaaaatatgagaattacgtttccgcactgaagtcgctgcgcaaggctcccgaacaggatctcagcaatgatttcatccagagcggcatcattgacaagttcgagttgcagtttgagcttggttggaaactgttcaagacgctgctggcttatgagggagaccctgtttctgcttccggttctccgcgagatgtgctcaaaaccgctttccaatattacgatttcatggacgaatcgttgtggctgcgtatgctgcgcgatcgcaatgattctgctcatatctacgatgaggaacgtgcccggcgtcttgtagatgccatcatcgttgattacatccccgaatttgagcgtgtgaatcaggggttggtcgttcgttacggcgaagcattgaacgattagcgcgggtgacattaatggcactgggcacgctgggcattggcgagcagatcaatggggtgaacctcggtaactggctggtactggaaaagtggatgaagccggggatttttgccgccagcggcgaagcggacgagatctggctgcatcggtctacggagtctgctgagttggaggctctgctgacgcggcatcgcgacacgtatatcactgaagctgattttcggaacattgccgcgcatggctgcaatctggtgcgtattcctgtgccgtattttatcttcggggatgtgtccggtcatccgggctgcatcgagtatttggacagggcgttcgactgggccgagcgtaccggtctcaagattcttatcgacctgcacacggtgcccggctcacagaatggattcgacaacggcggcctcaccggcgtggtgcgctggcatcatagcccgcgagcggtcgcctatgcgttgaatgtgctggcctgtctggctcgccggtatcgcgatcgcgcggcgctgttcggtatcgaggtgctgaatgagccgatcgattggttgacgtatgctacgtcgtcatcgagcaggcaggcaaaggatagctttgaagcacggaggagtgggccgattccaatggtgttcctcaagcgtttctaccgtgagtcgtatcgccggttgcgcccgattttggacgagaaccaagccatcgtgttccatgacggcttccgactgggccgttggcgggactggtttgtgcgggagggcatgcggggcgtcatgctcgatacgcatatctatctggtcatggccgagcattttccgctattccgtatgattccggagcgatggatgatgagctgttataggctattcgtgcgctggaatgaacgccgtatccgccgagcagcgcgctatacgccagtgatcgtgggggagtggtgtgtggccaacaatctggtaaatcggatgatcgctaagcattcgggcgatggcggtcgctccgaggaaaacgctatgcacagtgcatcaatcagaggctctatttaccgcgaggttgccgccatgcagcgcaaagcgtggagcgtatccgccgggcagatttattggagctaccaattacgtggtaatcgtgatttcttgcctaccatcgacccacaatccgacacgtcacgcctcgacccttgggatttcactcacgtctggcatgctggttggatggtgtaatgagaacgaaattgctctctggtggcatgattcgagccaattgtgtaaggtagagaatgagcttcgtgacccggcctatcctttgcggcggggtgggttgcgggttcgagatgagaagtcagctgccgctggcacttgattcgtccgcgcggatgaataccgcgaaagcagggtgcctagcccagtggctgggtgatacggttgggccaaccgaagccactaccgattccacttcgaaagtagtggatgatagtcatgcagaagactgtaaaacatggcttttcatctcaggagggacatctggctcagatgtccctcccttatttttcggcaaagggggagccgtgaatataacgaagacaaaggagtatgcattggcgcaagcccatgctgcggctctcctgtatcatgagcgacttgaaggccgttcaataaaaattcactgtgaagatgatctgactcttgccattgtttgggactcgggaaatttcgctcatctatgtggcttggattattatctggatgattccaagcgatgtcgtcttcctcctagaaagctctatgaggatttgcttaggggacgcagaatctcacctaagcgagtgagtcctcatggtgatgtgcaatggttgaagaagaaggcagatgtcctgaccgatgccatggatatgtcaaaggtgacacatgtcgtagtgccgggcaatagcaggatcgtactgtacgcaggcaatgaggtctggtgcatcggtctcgggcgtatgcgtgatgggcggtattatccgcaaccgttggtaaagaaatctttcgatgaagtgcggaaaacgggtaccgtcacacatatcgtggccgcagtcgaaacgatggggctatggcccgaatgaaaggccggctcagcggtagccgttccagtgggggcgagggaacaggatgtcctcgtactgggaccagctggacatgaagtcgatgtctggctcgccaagccagcgggattgcaggccctccatggccgagccgacgcacatcgacagcaacccgatcttctgcggggtgttatattcgggcggcagcttccacggatagctgccgatctgcgcgcgcagccgtccgccacgctgggcgtagtactcgtgcgccgggtgattgggatcgatggcttcggcgcgcagcaccagatacagctgtgtgagttgcgggcgtttcatggtgtcctcggcgatggtccggtaatactcgggcatcagcagaggagaaagctcccgctgttcgggcgtaagcgcaagtttgctctgaatgtagtctccggcttcgctggaatcttcgtatcgacgcagcaccagcatcagcagcccgttcttgttcttgacgtatttgagtagcccggcctgtgtgatgccgacgcgatcggagacctcctggatggtcatgccgtaatagccgcgctcggccaccacttcggtggcggcatcggtgatcgccttgaggcgttcttctccgcgcgttcccatggcatgtctcctttcgtccggctttggatggtccgcgcccggcggcccaactgcgatatgagccatgatagccgtcatcccggcgtgtctcgcattgacacgctagaaagtaagtagtaacttacctaataacaaaagtaagtacttgcttacctttggttcgccggtcagattcaatgatggaaccgacccggcgcacgcaggaggaaacaacagcgaacatggaggttcgaatgtccacccaaaccaagtcgtccagccgcccctggctggtgttcatcggctgctgcgtattgtccctggtcggattcggcctgatcgtcaacacgcctggcctgtacttcaccgtcctcggcgagacactgaacgtctcgcgcacgcagatcgcattggcctcgtcgatcatggctatcgccggcgccgtgaccatgctgttcgcgggcaaggtcatgaagatgctcgattcacgcatcctgatcagcgtgtgcatcgcgggcgtcgccgccctgttcctcgcccagtccttcttcaacgcggtctggcagttctacatctcattcgcgctgatgggcattctctacgtcatcccgatttccctggcccccagcgtgctgctcgccaactggttcgaaagcaagctcggcatggtgatgggcatcgcccttggcctgtccggcatcggcggcaccatcttcaaccccgtcgtctcctggttcatcaccaatctcggatggcagacctcctaccgcctaaccgcactgatcctcgtcatctgcatcctgccgttctccctgctggtgttcaagttccgccccgacgaagccaagggcgagcaggcctacggccatatcgtctccgctgccgtcgccgatgacgcccaggccgccggcgagctgcccggcatcgaatccaagaaggcctaccgcaccccgacgttcgtgctgctggtgctcgtctccgtgctcctgcagattgtggccgcgctggtccagcacgtctccagccatgaaatcgcccatggcctgacgctggaacagggcgcactggtcgtctccggcatcatgttcggcgccgcgattggcaaggccaccatcggcatcctcctcgactatctcaagccggaactgaccatcgtcatctactccgcgatcggcctcgccggctggggtctcatggccgtcgccaccacgcccaccccggccatcgccgccggcttcatggccggactcggccaaggcgtcgtgctcgtcgccctgccgtgggtcatccgcaagtccttcggccagcgcgattacagcgagatcctgtccatcgtctccatgtttggcgcggtcgcctccgccatcgccgtcaccgcgcatggcgccgtgttcgacgccgccggctcctatgtgccgtcgctggtcggcaatatggccctgtacgtggtcgccgcggcctgcatggtcatcggattccgtatgcgcccgttcaaggaaatcacgaagcaggccaagtgaggccgggcaaaaccgattccagacaaacgtatatataaggaatataaggagtattcatgagtgacgcagacgacttcatgacccgatatctcaacaacatcaccagccagtacgaatcctcccgattcaagccggaatacgagccggccgagcccgaaacaaccaaggtcacctgccgcgacggcgtcgagctgacggtcgacatcttccgcccggccactcccggcccgtacccgaccatcgtggtgcgttgcccctacccgcagcaggtcgagctgtggaagctgcacggcgaacatctcaatcggcgcggctacgcgatggtgtgcgaatggtgccgcggcacctacacctccggcggcacgtgggaaccgaacgtcaacgagcgcaacgacggtgccgacctgctcgcctggtgcgaacatcaggactggatcgacgtgatcggcctgtggggcacctcgtacctgtccctgacctgctggaccgtggcggacatcaccacgccgaaggtggcctccatctgcgccaaccactacggcaccgaccggttcgcctccgcctaccaaaagggctccttccgctgcgacgtgctcaccgcctgggccatgcagaacgccggatatccggtcgacgccgattacatgaaatccgccctccacctgccgcagatgagcgtggacgaggacatgtggggcggccgccttgactggtatcgtgactggatcagccaccccaaggacgccgacgcctactgggatgagggattctggggactgctcaagtccatcccctccaaggtcaaggtgccgatgttcatccacgagggctggtttgaccaccacctcggcagcgccctaaccgggtacgccgcgctgaacgagcaggtcaaggaacactcctggctgcgcatcggctgctggaaccactacttcctcaatccgctggaaggactggaaccgaagcatctcgacgccgccgaagtgccggccgcgctcgaatggttcgacctgaccctgaagcggaagcagacccccatgcggcaggtcgagtactacgagatcggcagcgattcctggcatgtcgccgactcctggccgctgccgtccgcaggcgccgacgaagtcaggctctatctcaagtccggcgaactgacggccgaagctccgcaagccgcgagcgccgccgaatacgactatgatccggccaacccggtcatgacccgaggcggcgaggccctgctcaccacgatggacgagattggcgcacgcatccagccggaacccgggtggcgcgatgacgtcatcacgttcgaatccgagccgctggaccatgacctgcacatccaaggcgcgattagtgtggacctgtacgtctcatccagcgctccggacaccgccttcacggccaagctcatgtgcgtggacccggacggcaccgcgcgcaactaccgaacttccatcaccacgatcgggctggatacgccggacgccgcgccgtacaagccgggcgaaatccgccgcgtgagcatcgacatgtggggcatctgctggatggtgcccgccgggtcgcgcatccgctgcgatatctcatcttccgatttcccgcaatactccgtacacaccaaccacgctggactgtggagcgaacagaccggcacgcaggtggcccaccagaccattcacatgggcggcgccacgccgtccgccatcgtgctgccggtgcgtggctgagatacggtttcgataacgattgaaaggaacgacaatgatcagtcaggaagcgcgcgacctgttcgccgccaacgtgaaggccatgaccgccggggacgcggcgcatctcgcctcccagttgctgccggacgatgtgagccgattgaaggacatcgcttatgtgcatgatggcgacgccgcgcatctgctggacatctacactcccgcggatgcggaggaaggcgcggctctgcccgtcatcgtggacttccacggcggcggcctgtattacggcaacaaggagaacaacgaatgccgtgacatgttgctcgcccgccaagggttcgccgtggtgaacgccaactaccggctggtgccctcggtgagtttccccgcccagctggccgatgcgatggccgtgctcgattggattcgcgaccatggcgccgaatacggcctggacgccgagcgcgtctgcgtgaccggcgattcggccggcggcgccttggccctgtacctctgcgcggccaacggttcgacgcagctggccggcaccttgggcctgtggcagtccggcatcgaggtgcacgccctggtggtgacctccggcatgttccgtttgcagggcggcgtgcacgccaatgcgctgagctattacatggagggctacctgcagacgcccgccgaccacatcaaggtcaacccctatctcgatctggacaagctcatcgtggacggcgatgtgccgccgatctacatgatcaccagcgtggaggatttcatcgccgacaacacctacgaactggcacgcattctgcacgcccggcataaggaccatgcgatgagcgtatggcccaagggtcgcgagcgggtgctgggccatgtgttcaacatcgtccaggccggcgatcccgaagcgggcgaggcacatcaggtgatttgcgatatcgccgactactgcaagcgctatatctgatcgccgttcgtgcggccgaaccaacagtgggggtgttctatcagtgtggaacacccccactctgcgtggtgagaagcgttatgcgggatcacagccgcaactgcagccaaagtgctcagcgatacccgtcccacaggggcaggggcatcagcacgtcctcgcagtcggcccacatggcattgaggtcttgtcctggggcgcgcagccagcgcagctgaaggccgtccatcatcgagaatccggcctgcagcacatgttcgacattgacgccttccggcacggcccagttgatattgagcgccatggtgaccgtgcggcgctcgcggtcggtgaagtaatcgtgcgcgggatgggccgggtcaagtgcctcggtgctcagcgtggagaacatgtgcaccagcgcgggccgcttgttgttcaccgccaccacctgacgccacatgtccgcaatgagcgggcgctcctgggcgaccatcgcggcattgatcgactcggtgacccggtcgtattcctcggtcagcgccagatcgagcagtccctccttgctgcccacgtaatgcagcacgccggccttggtaagccccacttcggtggcgatgcgttgcagtgacgtgccgtaatagccgagcttgccgaacgattcgacggcggcgtcgagaatcgcggtgcggcgatcggtatcggtgggggaggggacgttcatacaggcaaccttacggtcggttagtagtggttccaaatgatttcggcgtgttgtgccggagattttgataatctacctaccaaccggttggtcgagagaaaacggcagtcgagattcgtggaggaacctcgaacaacagccaggcagcccggccgaatcggaaccaacgcatatcgaacaaccgcacaattcaagacagcagcgcaagccgcacaactcaagaaactcaaggaaagaggtaacatgagcgaggccatctacccgtccgtcaaggatctgaccctagaagagaaggcatccctcacctccggtggcgacgcatggcatctgcagggcgtggagtccaaaggcatcccaagttacatgatcactgacggtcctcacggtctgaggaagtccctggcctccagcaccggtgagaccgaccttgacgactccgtgcccgccacctgcttcccgccggccgccggcttgtccagctcttggaatcctgagctcattcacaaggttggtgaggcgatggctgaggagtgcattcaggagaaggtggctgtgattcttggccccggcgtcaatatcaagcgcaacccgctcggcggtcgctgcttcgaatactggtccgaagacccgtacttggccggtcatgaggccatcggcattgttgaaggcgtgcagtccaagggcgtgggcacgtcgctcaagcacttcgccgccaacaatcaggaaaccgaccgactgcgcgtcgatgcccgcatcagcccgcgcgccctgcgcgagatctacttcccggccttcgaacacatcgtcaagaaggcccagccgtggaccatcatgtgctcctacaaccgcatcaacggcgtgcattccgcacaaaaccattggctgctgatcgacgtgctgcgcgacgaatggggcttcgatggcatcgtcatgtccgactggggcgccgatcatgaccgtggggcctccctgaatgcaggcctgaatctggaaatgccgccgagctacaccgacgaccagattgtctacgccgtccgcgacggcctaatcacccccgcccagctcgatcgtatggctcagggcatgattgacttggtaaacaagacccgcgctgcaatgagtatcgataattaccgtttcgatgtggacgcccacgatgaagtcgcccatcaggccgctattgaatccattgtgatgctcaagaacgatgatgcgattctgccgctgaacgccggtccagtcgccaatccgtccgccacgccccagaagatcgccgttatcggcgaattcgcccgcaccccgcgctaccagggcggcggctcctcccacatcacccccaccaagatgaccagctttctcgacacgctcgccgagcgcggcatcaaggccgacttcgcccccggcttcacgctcgatctggaaccggccgacccggccctcgaatccgaagccgtggaaaccgccaagaacgccgacgttgtcctcatgttcctgggcctgccggaagccgcggaatccgaaggcttcgaccgcgacaccctcgacatgcccgccaagcagatcaccctgctcgaacaggtagccgccgcaaacaagaacgtcgtggtcgtgctgtccaacggatccgtgatcaccgtggccccgtgggccaagaacgccaagggcatcctcgaatcctggctgctcggccagtccggtggcccggcgctcgccgatgtgatcttcggccaggtcagcccgtccggcaagctcgcccagtcgattccgctggacatcaacgatgacccgagcatgctgaactggccgggcgaggaaggccacgtcgactacggcgagggcgtgttcgtcggttaccgctactacgacacctacggcaaggctgtcgactacccgttcggctacggcctgagctacgccacgttcgaaatcaccggtgtcgccgtcgccaagaccggcgcgaacaccgccaccgtgaccgccaccgtgaccaacacctccgatgtggacgctgccgaaaccgtgcaggtgtatgtggctccgggcaaggccgacgtggctcgcccgaagcacgagctcaagggcttcaccaaggtgttcctcaaggccggcgaatccaagaccgtgaccatcgacctcgacgagcgcgcgttcgcctactggtccgaaaagtacaacgactggcacgtggaggccggcgaatatgccatcgaagtgggcgtgagctcccgcgacattgccgacaccgttgccgtggccctcgatggcgacggcaagacccagccgctcaccgaatggtccacctacggcgagtgggaggccgatccgttcggcgccaagatcgtggccgccgtggccgccgccggcgaggccggcgagctgccgaagcttccggataatgcgatgatgcgcatgttcctcaactccatgcccatcaactcgctgcccaccctgctgggcgaaggcggcaagaagatcgcccagttcatggttgacgagtacaccaagctgagcaagtaatactacgcaaactgccagctcccttttctgagattcagagaagggagccagtttgtgtatagggcatatgtgggattcgttgtctaggcaacacaccgattgttgtatatgcaactgttgtatatgggtctctttatcatgaattgttgcgtatgcaacaatgtggggtgaaggcgcatacgcgcatggcctcgcatggtacggaggacaatggatcagcatattctcagcattgagatgcgagcggtgaccaaagccgtcgaccgctatctcggtgagagcatgccgctttccgctaaggagaccactggcggcaacgcgcatatcatcatgttcctggctcgtaaccggaatcgtgaaatctaccagcacaccatcgaacagaagttctgtatcacccgctccaccgcttcgcgcgtgctggcgcttatggaaaagaaagggcttattgcccgcgaatcggtggcgcatgatgcccgttgcaagcgtatcgtcctgaccgataaggcggacgccatcgtcgccgatctcaaagcgaacggcgaacgcgtcgaacgtctgttggttgatggcttttccgaaagcgagaaagcagccctacgtgactacgtcagtcgcatgcgcgcgaacatcgaccgcgcacaacatgaatttgaacatcaaacactccctcagtcacctgtggtgatggctcccgatcaagacggagcggaggttgctaacacgaaggaggagaacgaatgagtgataccgcagaggcaatcgcgcaggcgcgcaaagctgtcgaaccggacaagcccaaacatgtactacgcacgctgggccattcgattcgtgaatacaagaaagccagcatcctggctccggtgttcgtggcggtcgaaggtattctggaaatcctgatcccgaccatcatggcttcgctgatcgatgagggtatcaccggtggcagcatgccggccaccgtcaagttcggcgtgattctgctggtgtgcgcgatggtttcgctgggtgccggcttcttgtccggaaagtacgcggccgtggccggcgcgggcttcgccaagaacctgcgcaaggaccagttcgagaaggtgcagggcttcagcttcaccaatattgaccggttctccaccggttcgatcgtgacccgactgaccaccgacgtgacgaacctgcagaacgcctacatgatgatcattcgtctgggcgtgcgtgccccgattatggtggtcgtatcctggctgttctcgttccgtatctccccgtcgatttccatggtgttcctggcctgcatcccgattctggccatcggcctgtgcggtctggccgtgctcgtgcatccggtgttcgagcgcgtgtttcacacctacgatgcgttgaacaacgtggtcgacgagaacctgcagggcatccgcgtggtcaagtcctataaccgcgaatccttcgaggtctccaagttcggccgcatctcccagcgcatcttcaaggacttcaccaaggctgagcgcatcatgagcttcaacagcccgctgatgatgatctgcatctacggttcgatgatcctcatcgcatggatgggcgcgcagcagatcgtcgcctccggcaacaaccccgccgtgggcctgaccaccggcgacctgaccgcactggtcacctacgccatgcagatccttatggccatgatgatgctgtccatgatcttcgtcatggtgattatttctcaggcttctgccgagcgtatctgccaggtgctgcaggaggaaagcacggtgcagaacccggcacagccggtgactgacatggccgacggctccatcgaattcgaccatgtcaccttccgctactccgacagttccgaaaagcccgtgcttgacgacatcaacctgaagatccgctccggcatgaccgtcggcatcgtcggcggtactggttcggcaaagtcgtctctggtacagctcgtgccgcgactgtacgacgtgagctccggttcgctgaaggtcggcggcgtggatgtacgcgactacgatctcgaggcgctgcgcgatcaggtggccatggtgttgcagaagaacgtgctgttctccggcactattgccgaaaacctcaggtggggcaacccgaacgccaccgatgaagagattcgccatgctgcgcagctcgcgcaggccgatggattcgttcaggaattccccgataagtacgacacgtacatcgagcagggcggtaccaatgtgtccggcggacagcgccagcgcctgtgcatcgcccgtgcgctgctgaagaagccgaagattctgattctcgacgattcgaccagcgccgtcgataccaagacggacaagctgatccgttccgcgttccacaacgagattccggacaccacgaagatcatcatcgcccagcgcgtggcctccgtgcaggaatccgacatgattctggtgatggattccggccgcatcatggcgtccggcacacacgacgaactgctcgccacctgcgatgaataccgttccatctacgaatcccagaccaagaaccaggcccagcccgaagaactggccgctgccgaacaggctgctgagtcatctaccgctgagccgtccgaaaccgtgacggtgacagtgaccatgcccacggccgataccagcgcagctgatgccaatgcagccgataccaaggaaggagaagcacgatgagcaacgaccagagtttcaagaaccgcaagcccgccatgggcaaagccgagcctggcaccatcaagcgcatcttcagctacatcttccagtacaagtggcgtgtcatcgccatcgtggtgtgcatcttggtcggtgccgccgcgcaggccggttccgcgctgttcctccagtcgctcatcgacacgtacatcctgccgatggtgggggagtcgaactccgactgggccccgctgctgcgggccatcagcctgatgccctctttcagcacctcggccgcaatattacgctgcctcaaataattcaaagccgcgtcaatccgtaccggttcaccatcgaaaatggccacgatgcccccctatcggggtatccgcgacgatgtcgatatctccaaagattatgttgacatcgatgccgaaccctttagtaatttgcgacaccaacgcttcagaaacttccttggacacatattgcatccggaccaatcgttggccttcagacaatctcatcaaaggggagtcatggttctcttttcatatctggcgataacgcatatcaaatcagcaatcagcgtaaagacgctcggtcactccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacgccttgggagcgctcaaacgcgcggggctcatcaccgtggcacgcggaaccggcggcgccgaacttgcccgcacccccaaggaaatcactctgctcgatatctatcaggcagtggaatccacaaacctcgatgatgtgatcggcatccacgagagcgggaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaattggaacagtagtgggcaccgaagcgtaagccccctactctttgatccacataaacagataaggcgcgcgccatcaagaccgatcgatgacgcacgccttatgcagctcagaccacggattcctagtcagccagcagccccagctcctgcagcttgttcttgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccgcaccatgtggcaccgtagacgtcgatggtcatatcgggtcctttctttgttccgccgcgcttgacttttacgcggtgcactatcaaaccgtattcatcgtaacggggatgctgcgatatcgcggttggcataatgcgggcggtccgcttaaccacccccagtcggctacgccgacagccctctgccagcaggggcggaaccagagcataaaaaagcggcgccggtgtggcacaaccgacgccgctccccaggagtagaaaaataggcagaaaagtattagatcaggcaaacacccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccggcccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcgacgatgattccccagcgagtgaagaactcattgagctgggaatacgatccgccataaatattgtcaccgaccacgatgcggtcgccgggcttgaaaatgctcagcaccgcgtggatcgccgcgagaccggaggcgaacgcaaaaccacgcgttccctgctcgagctgggcgatctgctgtcccaggaagtcacgtgtgggattgccgctgcgtgcgtagtcatagcggggcatcgcgtcgaccctctcgaaagcatatgtcgttgaattgtagatcggcgggttcacggctccggtgttgttgtctccaaccggcagtccgtggacgagctgagtattgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatgaacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcacggcgggcgcgatggtgtcgtcgtcaccaaggtgggtgatgccaaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctgactgacatcggtgatctgggcgctctccggggagaccacaccaagcgccaccttcatgtacggcttggcgaagtcgaccttctccttgcgctcatcggtgacggtgaaattggcgagcaccagatcgaccttgttggaggtgagcacgtccacacgggcagccgggtcaaccgacgtgtattccggctccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgcccgtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatggcacaatcgaatcactcgaattcgaaggtgtgcaggaactgctgcgcacgttcggtttgcgggtgttcgaagaacgcctgcgcatcatacgattcctcgacgatgcgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacgacaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttgttcgggaacaaatcgtagctttggaacaccatgccgatacgcgtgcgcagttcactggaccggtcggatcgtccggctcgttccgtgccaggcttgccggcatcgatcacctgatcgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccagtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagcgtcatcaaccagcccaccaacaggccgaccgggatggacgcgcctacggatacgccggctatccacacggtgacccacaggccttgcaacagacgtgggaatacgcccggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctgagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattgggcgcgctccttcctttgcttctcgtttcttctcctgcgcataaacggtcttagccacccatgtacgatttcgggggccgaacatacctgtccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcccgaaaccgctccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattagacaagcaggcgactgaagccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacgccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtctacgtgggcgaattcagggactttataccatttgacggggtagccggcaccgtgggcgcagaagaccgagtcgggggtgttgtccagatctgcttcgggatcgtaagcggcggctgcgatgacctgttcggcgtcatggcatggcttgtagccgccgaaagtggcggagaaacggccatggccgtgcgtgtactggttcacatccatcgcatagtcgtgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccgataccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgattggcgcagtgatggtctcacggtacaggatggagccggggccaaacgacacatccagaccgaaccggtcgtgcagggtctgctggatgatctccagctggactgcgcccatcaattgcacatgaatctcggccaaccgctccacccagaccacatgcaacaacgggtcttcgtcttccagctcacgcaatgcggtgatgaccttatgcaaggtcagatcatcgaactggggacgggccggcgagctattgtccgccgcggtctggccggcggtgtcgttctcctcattgcggccggttcccgacttggcggcatcatgctcggcatcgtcctgattcacgttgttatggccggcgtcaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggcacctcggtgaccgtctcgaatttggcgccattgtagacgcgcacctgatcgactttctcggaccataccgtgccatcatccccctgtaccggcgacggtgctgatgacgccgcagcgcacgaggatgaagagacgatctccttggctttgagcgcaccaccggtgacgcgcagccacgtcatacggttgtgctggccgtcgtgggcgattttgaacacgcgtgcggcgaaggcggccggccattcacgttcgcgggtgaacgtctccagcccgtccaggaattcctcgaccccttcgagtttcaatgccgagccgaaatatacggggaacagttcgcgtacggcgatcatcgctcgcaatctgcccacggacagcgcgccatgttccagatagtcgttcatcgcctcctcgtccagggtggcaatgtcttcggcgaacgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccatagtgtctcggtatggccttgcacgccatccgtgccggagaccacaagaatcgcgtaatcaagcacacgcagcacacgttcggtttcggctgcgaagtccacgtgccccggcgtatccagcaaggtcaggcgcaggtcgccgtgttccaccaatgcctggtgcgcgaaaatcgtgatgcctcgcgccttctccaaggaattggtgtccagaaacgcatcgccgtgatccactcgccccaatttgcggatctcaccggtacggtagagcagagcctcggacagcgtggtcttgcccgcgtccacatgcgccacgatgcctgccactatctgtttcatcagctgtgctcccttcccgatgcgccgcgcaattgccggccgcctaaccaatatatccgagaaaatccgggagggaaaaattgtaccgacagaccgggctgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgatctcgatccgattgacgaggtgcttccccgattcatcgcatggctcgctaccccggctgccggtcccgccgttgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattacgtcaccgagcatcacgaaaccgaagcaatccgctggaagcaggcgccggccaaaaacagcgccgaaatcctccaccagcagttggtggtaaagaggtagtttacagcccgtattccttggcgatgacggaccagaggtcggcagcggcctgatcgacggtttcgttgacgatggtgacgccgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttcaacaaggtgccataatgggccatgccgtgcaccactgcagtttccaggaactcaccggccgcctcacgggccaggaactcgtcttcagtgaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaacgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgataaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagacccaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcgatgagctgaaccacgttcttgcccacggatccggcagcgtgatgcacctcgaccggggcttccggatcggtgtccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttaaccgcgacctgctggccggggtggatgtcgccgccgtcgcccttaggcagcagcagaccgttggcacgctgatcggcgatggtttcgccggccatgatgcgggcagcagccttggccagtgccacgccggtggccttggaggcgaacggcacggtacgggaggcgcgcgggttggcttcgatcacgtacagcgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggagtggacaccggcctcctcgacgtgctccataatgccgccgatgtatagttcctcgccgtcgaacagtgcgtcgacatcgatttcgatggcgtcttgcaggaacttgtcgatgagcagcggggagggcaggcgaccggagaccacggtatcggccttggcctcggtaagtgcgcggtccacgtacttgttgagctgcttgtcgtcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcagccttcagacgcgcggccagggacagcggggtctggccgccgagctggacgatgacgcccttgaccgggcccatcttcttctcggcctcgtagatctcgagcacgtcctcgaaggtgagcggctcgaagtagaggcggtcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcttcggggtgagggtttcagcctcgcgcaccgtcatggcggtctcattgatgaggaagatctgcttcaggaaccacgggtcgatcttggtggccgcgaacacctgctccagcgtggcgccgccccagatggcgcgcatgagctgcaggtaacggtgttcggtcggggtgtggatggtctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagagccagcttggtggcgatcttggcgatcgggaagccggtggccttggaggccagtgcggaggaacgggagacgcgcgggttcatctcgatgacgatgatgcggccggtgtccggatgaacggcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccagccctcgatgccctcttcgatcaggacttcgtcggtgggcgagtaatggatgccggcgccggcgatgcggtgcagctcctcctcgttgtgggcgatgccggagcccaggccacccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttcttcaggacgccggcctcgcccagcgccatggcggcgttgagcgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccgggtcgcccggaccgttggagaagaagacgccgtccgggttcaggttctcgatttcggcgaaggtgatggtggagggcaccacgtgcacgcggcagccgcgttcggccatgcggtgcggggtcatgcccttgatgccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcgccgtatggctcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttggacgcaaagtctcacccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcgggctcgtcggatgcaccggacgaatcgggcgaatcggaaacatcgccctcatcggtcggctcggatgcggcggcagcggaatcggacgattcctcatcggcctcttctgccacggactccggtgccggtgctgcgttcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcggtgccttcgagcaggaacttggccttgtcgcccagaagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccataccgggtatacaggaagtgaacgctggggtttcccatgtgcccccggctagactggatgaatatgcgatccttcttcgaagccatatccgtgtcctgcgtcatccccgcgcaaccgcaggcaggcggcgaacgcactgtgttcgagaacctgtcctttgctgtggagcgcggcgagatcgtcgatctggtgggaccgtccggctccggcaagtcgagtctgttgaccgcgtgcgcccggctcaacccgcatgcgcacggcgcgttcgcccttgaaggcaagggcagcggcgagttcacgccgcagcagtggcggcgggatgtcgcctacctgccgcagaagccgattctgacgggcaagaacgtggccgaggcgatccgcctgccctggacgctcgcgattcgcggcaagggcggcaagggcgagcatctgctgcccgacgagcgcatccgcacgacgttggacgcgatgggctgcgaggacatcgatctggagcgcgccccgcacgacctgtccggcggccaggcggcccgcgtggccctggcccgcacactgctcaccgatccgaaggtgctgctggccgacgaggtagacgccggtctcgacgacgacaacgcggccaaggtggctacaatcatggcggacgcggccgcacacggcatggcgatcatccgcatccgccaccgtccgccggacggacgggccacccgcacgctgacactggacaaggggcggctgaccgaacacgagatgacggatccggcggcgcaggacgcgaacgcggtgtctgccggcgccgatgaaaatgaggagacgcaggcatgagcggcgatctgggcaattcctacaacatcgatatctggggtctgctcatcgcgctgggcatggtggccgtggcggccatcatcagcgaactgatgcacatgggcatcggcaagaccctgatgtggtcatcgtgccgcgcattggtgcagctgtgcgccatgggcttcatcatcggctacgtgatccggtcgaacagcgtatggatggtgttcgccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgcccctgaccggcatgctgctgggcaacaccgtaaccgccttggcggtgggattgagccgtttctacgagagcatggaggagcggcgtgacgaggtggatatgatgctggcgctgggagcgaccccgtgggagtcggcccgcccgtccatcgtctcgtcgattcgcttgggcctgctgcccaccaccgcctcgctggcgtccagcggcatcgtgacgatcccgggcatgatggccggtcaggtgatcgccggcggcgacccgctcaacgccgccaagtaccagttcgtggtcctcgacgccatcgccgcgctgaccctgctggccgacggcctgatcatggtcatgatctaccgcacctgcttcaccgccgacgaccaataccgcccgcccgaagcgcgctaatcagctaagctccctctgataagctccctctgacgagggagctgtcgagcgcaacgagactgagggagagaccaccctacgcgatggtgaccagcgtgccgtccggcacctggtcatagaaccattgcgcgtcggccacggccaggcgcacgcagccgtgcgaggcgggctggccgagtttggcaccctcctccggcagatagtcgccgaaggcctcgccggtcggcaccgagtggaacaggtacgaaccgtagaactgcacccaatagtcggcgcccatgccttcttcggcattgtagaagtgttcaccgcgcgtatcgatggtgtacgagccgtgcggggtggcgtcgtcgacgccggtactggcgatcatcgtataaatggtctggccaccggacttgacgtacacccgttgtttggcgagactgacctccacgctcaggtcggagtactgggataggtcgggctgtttgccggtcggtcccttccagtccacgctttgcgcggctttgtcatcgccgttctgcgtgttctgcgtcttccgcgacccgccctgtttgccgctatcgggaacctgcttgcgggtaacggccgtgggctcgttcgccgctgcggttgcggcggcggttgcggtgtcggctcgcggccagctgcgctgcgccgccgcggtctcgactccggcgccgatcaggcagaacaggatacagcaggcgaccactccgcgccgaatcacgtagacccgatcgcgactccaattcacgttcaacgtcggcagcctcaccatatgcctcttctcaccacaaagaccattcgggtcgattgtaaacaggcattgcgacgccctacgcctcggtttcagccgtgatctcgactgcaggaacggcatcgtccggggaatcttcgcccgacgccggcaccgtccagcgccgccgcagcagcatccacaggccgatgaagcacaggagcccaccggtacggtggtagacactcatctcctgagtgagtcgctgcacgcggtcggcaatctggcgcgtacgggtatgcgatttgacgatggagaaacgtgagacgcacagcatcgcgtagtacacggcgctcacgatgaacagcacggacatcgtccacaatcccatcgccagtttgacgatggccataatgccgccgagcgttgtggagaaggcgacggccagtgcgactttgtcgttgttttccatggcgcccaggatgttcagcgtggtggatttgccggcgccggatgcgccgaggagactgcctggccattcctgcaaccggtcctgttccccggcgagccggatatcgactccatcgccgatccggccgaacgcaaacgccgcatccttctgaagcagttctacgtttccggcatcatcggcacattccgtgcagcgctaagcggctcgatcatgaccacccccaccgagatcgggcactttgtctccgaagaactgctccctcgcatcgcgccgcatatgcaaatgccatcgcaatcggaaacagcgcagcagccagcggcatcaccgcaagcccagtagcgaggtcaacccacagctggcggcgcgggaaacaggtcgcgccgcccagtacgcgaatccggcgagcttctaccgagtcgcgaggaagaagaaacgtgggaaggggaagatgatgctgccgtccgactgtgtggggtattcctcgcggacttgggcgaacacttcggcctcgaacttcttgcgcccggcgtcgtcaagcgcttgcagatacggcctcatgccggtgccacgataccagtccataaccgcctcatgcgagggcagcgtgtgcatgtacgtgaccttccacatgcggaaggcgctggcatgcgcatgcagcagctcccagtattcgggcggcgtgaggttgtagaactcgcgttgctgcggcagcttgtccgcgaacgcgggcgagtgcacgataccaccgatgatgcggtgaatcggctcctcatagttcatcggcgtctgcacagccagcactccccgaccctgagccgggcgagcagtccgggaatcagatgcggatggtccggcacccattggatgcaggcattggagaagaccacgtcgaagtcggccggcagctcgtccagccgcgcggacacgtcgcacagctggaaatcgatgtcgggataggttttgcgcgctgtctcgatcatgaccggcgagctgtcgacgccgagaatcttggcatggggatagcgctcgcgcagcacggccgtgctgttgcccggcccgcagccaatatccagcacgcgcgtgacgctgccgtcgtccggcggcagctgcatcgccagatcacgcgccggctgcgtgcgctcccgtttgaatcgcagatactgttccgaatcccaggtaaccatgctccccacgctaatcagccattcacatatcggccgatattatctcacaattcagccgagcagggcgtcgcggcgggcgatgagcccgtcaatcgcggcctcgccttcgatgacagtgaaggtcagggacttgcgttcgctggcctgcggggcgatggcgtgcaggtcgccgcgctgctcgtgccagcctcggccgtggacgctggagttcgagggttcgaggccgaccacgtagtcgcccgcacccgtcgacttccattccatgaagtatgggaagaggctggcgtcgaagtcgatgacgactccgagtccgagcttgcggttgaccacggcggcgaagctgcggccgttctcgtcggcggcgagctcgtgcaggtacacgctttcgggactgatcgtcgcggaaggattcgttggtcacctcatcctcgaccgtgatcgacagccggccgtacacgctggtgattgtgcgacgcagtacgaggttctcgccgcggtattcgaactggcagacgtcgagggcgcggtcggccatggacacgaaacgcaacggaccgttcttcacctcgatggccttgaggccgtgggctcggccttcctagtattcgatcgggcgcacgtaggcggcctgctgaaggctgcccatatgggccagcatgtcggctcgcgtgctgtgttctgtggacgtcatcgtcgtcaccgatccttgatatttatgcctcacgcctgcgcagcggcggcatccgcggcgtcgttcttcagcgcgcgcagcagggccttgttgcgggattcgatgatgcgcttgccgtcctcgccctgccaggagaagaagccctggccggttttggcgccgagattgccttctctgaccttctcggcgagcagcgggctcgggccggtgccgttgtccatatcgtcgaacaggtaagtgctgatgttatagaacacatcgaggccgccgaggtcgatgctggcgagggggccgaccagattccagcgacggccgagactgtacttcatcacgtcgtccacggtggccgcgtccgcgatgccctgctggacgatgtagaacgcctcgcgcagcacggccagttgcaggcggttgcccacaaagcccagcgattccttcttgatcttcgccggcttcttgccgatcttggccatgaggtcgaaggtgatgtccaccaccttcggatcggtcttctcacccggcaccacttcgaccagcggcatcaactgcgcggggttccagaagtgcgccaccacgaagcgttcgggcttcttcagcaccgactgcagcgcggtggggctcaggccggaggtgttcgtggacagaatcgcgtccttgggggcggcgtgctccacttcggcccagacggacttcttgatgtcaaggttctcggccacggattcgatgacgaagtccacgtccgccacgccgctcgcatagtcggcgtaaccggtgatgcgggccagcaccgcgtccaaggtgtcgccatccttgagtagtccggcttcggcaaagtcctcggcatccgaacgaatcgccttcatcgccttctccagcgaggcctcgccgcggccgaccagatgcaccggatatccggacaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgctcgcattctatgccgatttcgctacgtgaacatttactgaacatttcgcggattcgactagtacaaatccccatatcagcacaaaagcgtggtgccgcaacaccgaagtgttccagcaccacgctgaaatgttcatgtcgttacgctgccgtcgcgcacccacagcggaatcgataggaaacctcaccggagtaggtgaacacgggggcgaccagcatggacggaccgaacatatactgacggtccagcgtgcggcatgccgggtcatcggggaactccacgaacatggaacgcatgaccggagtaccgttcacatgaggctgcaggccaagctggtagacatacggcatgagttcaagcttgagcttggtgaactcgcgcaccacatccacggcggtctggccgggcaccaatgcgacgccgttcttctcgtcctcctcgtcgaacagccacggcacacggtacacggtggaaccgtgcagtcgcgagtgggagccgagcatgccgaacgccacccaacgcttgtagacggccggatccgggaacgcaccttcgaagccaccgatgtcgtgactccagaagccgaagccggaggaggtcagcgacaggccggcacgcagggactgggccatgccattgaaggtggattcgcagtcaccgccccagtgcacgggctgctgctggccgccgaccgtcgcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatgcgctcgccgaaatcggtcttgatggcgtccacgccctgattcagcagggccttgaccttgtccttgaaccattcacgggcggccgggttggtgaagtccaccaagcccatgccggcctgccagaagtcggtctgccagacttcgccattgggcttgcgcaccagatagcccttgtctcggccctccttgaacatttcgccgcgctggccgatatacgggttgatccaagcgcagatgtgcaggcccttgtcctcgtgcaggcgcttcagcgtggattcgatgtcgccgaagaaacgcttgtcccactcgaaatcgcaccaatggaactcgcgcatccagtagcagtcgtagtggaaggccgccagcggaatatcacgttcggccataccgtcgatgaaggagttgatggtggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcgcggtaagtccgccagtggtcagcgtgacatccgcgccattgacgccgacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgcaccacggaggtcggggcgaggacgttgaggctttcggtggtggcatccgccgccagttcgtaggcttcacgagcgtagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgtgagccccctatagcgctcccctacgcaatatgtccgcaaacgaccacaccacatgggcgatacgcgccaattcggcgtaacgtccgatggacagccactgcacacggtaccgttcgaaccacaactccaaatcggcggcaagacgggcgcggcgcgaggcatccagcgcacggccggtcacatccttggtgccacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggaccgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacagcaatatgacggtgccgttcatcgctgccggcgcacccgcgcccgcacccgcacccacgcccgcatctcgcgctttttcggcggcattggcaccggcgtcggcttcatctgtggctgtgagtactcggcgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgtcgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagaggtgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgacccgctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgtcgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagctagagcgccgccctgtcacggcggaggtcaccggttcaagtccggccggggtcgctggaatggttatgaagcccggattatccgggtttttgactgttcatggctctgtagctcagttggtagagcgagcgactgaaaatcgctaggtcaacggatcgacgccgttcggagccaccataatgaagccccgccttgtgcggggcttttgcatatccgtcacgtacctactctggcgggctggccggtcaatgcaaaggctcgcgttcgccaacaactgtcttcctcgccgcaactacgcacgccaacagcaccaatgcgaacatcgggttagggttaaacaaagaaacgtgggtcttatccgcgcgtgtcatggtcggtgcgatcgtccgccccagccgtttctggggttgtggcgctcatagagtcagtattgcagaaaaagcacctgcgaaatgcgcgtgcgaagggaatcgtgtgggacggcacgtgattttgccgattttcgacgtgccgtcccacagcgttcgaagaacgccctcagagctgagggcaaagaacggctctattctgcggttctcggcttatgtcatgcgggatagcagatacgtcaaacgattgatgtatctgctatcccacacttctgtgggacggcagatgaacaatggtaaaaaccgcgtgccgtcccacaaaaaggaatcaggcctgccaccattggcgcagggggtaccacttgccgtccgggtgggccacgcgatccggcttgacggccaagaactggtgaatctggatgccgtcgagctcgaagttcagagcgcaggcggccatgtacataccccataccttggcgcgttcaaagccgacctgcttgaccgcgtcgtcccaatgctcggagaggttctggttccagtgatgcagggtgagcgcgtagtgctggcgcaggttctcctgatgcaccacgttgaagccggcgtcatggatgcacgattcgatgaagccgggcgcgccgagatcaccgtccgggaagatgtaacggtcgaggaattcgtcggtaccgggcttgccgtgaggcttgtcatggctgatggtgatctggtggttcagcagtcggcccatcggcttcagaaggcggaacatctcttcgaagtagctctggtagttcttgacgcctacgtgctccatcatgccgatcgagcagataccgtcgaagtcgtgctcaggcacctcgcggtagtcctgcacacgcacttcggccagatcctgcagcccttcacgggcgatccattcgttggcgtacgcggcctgttccttggaaagggtgacgccgagcgccttgatgccgcgacgggcggcggtgatgaccatcgaaccccagccgcagccgatgtccagtaagcgctggccgggctgcaagtccagtttgtcgagaatcaggcgcagtttgttggcctgtgcgtcttcaaggctcatgtgttcgttgtcgaataccgcgcaagtgtaggtcatggaggatccaaggaagtcggcgtagaactcgttggacatgtcgtagtggaagctgacggtttccgaatcggccttttcggtgtgcggcatcaggccacgcttgatacgggcgaacttgctcgggccctcggtggcgggcaccggcggcttcttgaagccatggctcaggatgccggcagatacgcgggcaattgatgtgggagtgagtgggcgaacgtatttggacagcgacaccagcttgcgcatcgccggatacgggtcggcgtagtcaatgccgtccacgtcgaaatcgcccagaatgtatgagcgcacgatgccgatttcattcgggtgcgcgagtagctggtacatgcagttcggcgtggcgattttgaccttcaaatccgcgtctgccgggccgaaatgcgagccgtcgaaagcgttgatacgaacgggagtggcggggtcgagaaacagggacgccatctcgccgaccgtcatagccttgccatttgccattatctacctcattctcttatgatgatcaccccaactgtcgaggtatcttagtcctcttcaggagactgaaaccgttgaatacaccatctggtgaaccagttcgcgttcggctgatgaagcacgaatggaattaggcatctcgcatattgattgcgctacgcgcgaagtaagcggatgagagacgagtttctcggagagcgtcagatgactccggaaaatggtcttatcgttgagatttcgggcgatggaactggtttggtcaatggacaataattcgacaagtgcggaattccgccatttcttgccattattttcagtgttgttctttcagcgtgttcccggattcaacttgtaagtgcaacggctggtttcgggtcggcttgttttgattgtagagcgccgccctgtcacggcggaggtcaccggttcaagtccggccggggtcgccaccaagctcctgacaaatgtcaggagcttttttgttcttttgccgtatttcgtggtgtagggcgaaatatggggttataggccaaaatgtgtgtctggtgtttagtcgtttgatggccattcgactctggcatggaagctgtttcagtcgatgccgatgccgtatcgcatggaaataccgaaggtttcgtgctggccttggggctctgctcgacacgccgatagtctgaatgacaacgtttgctattgaatgacaacgttagcgttaacagtgcttataaatggtgaaaaacgtgtgcagggtcacattggcagaacgtgcgcgagatatgacaaatcatgaaaaatacgctatgggaggtcatggcaactcgttactattttcgctgtctcgtacgccacacaagccttcaaggagtaagccatgaccacgctcgccattgatatcggaggaactaagatcgccgccgccgtctgcgatgaaaacgatagcatcatccagcgctggcgcgtccccacgccgatggatgccgacgccatcaaccagcacatcgccgaggtgtaccgcgaggctgtggccgccggacacaccgatatcgaggccatcggcatctccgccgccggcaacgtgagcgccgaccgcaagacgctcaccttctccgccaacatcccggcctggatcaactacgacctgtccgagcacgtcggcgcgctgatcgaccatgccgtgccggtcgttgtcgagaacgacgccaactgcgccggctggggcgaatacgtgcacggtgccggccagggcagctccaacatggtcgccctgaccgtgggcaccggcctcggcggcgccatcgtgatcaacggtcagctgtaccgcggctccttcggcatggccgccgaactcggccacctgccgatggtcccggacggcgaccactgcggctgcggcctgcgcggctgcgccgagcgctacacctcgggcacttcgctggagaacttcgccaagtccgccgtgcgccgtcgtccgcaggatgccaagcgtctcatggagctgtgtggcggcgacatctccaagctggaaggcccgatggtctcccaggccgcccaggaaggcgacgtgctcggcctgtacgcattcggcaagatcggcgaatggcttggccgcacgatggccgcagtctccgccgtgctcgatccggacctgtttgtgatcggcggcggtgtggtggccgtcggcgacattctgctggagccggcccgctacaactaccagcgtttcctggaaggcagcgcctaccgcggccatgccaagatcgtcgccgccaccgccggccaagacgccggcctcatcggtgccgccaacctggctctgcgctgacgatgccgctccggcaacggggcgttagtctaatggtgagtcatggccggtgccatggctcactgccgcgctgatagtgcggtcgatgagtttccgctgcctgaccatggaatcgaatttcgggttctcggcgatttcctcatactcgtgttcggtggtcacgccggcgatttcggcgataatctcctcataggacgtttcgacggttcgatgcacgccggtgacgtgcccctgacgtatcacgacaatgcggtcggataccgcgaacacatccggcagatcgtggcagaccatcaccacggaccggccttcggagcgcagtcgcttgatatatgcgagcacttccgccgactgcatcaccgacagtgcggcggtcggttcgtccagcagaataagctgcgggtcattgagcagcgtgcgcgctatggccacggtctggcgctggccgacggataaggatgcgataggggagccgacccgaatcgccgagctcagggtcttcagcacggaacgggcacgcgagttcatcgaatcgtcatcgcgtatgccaatctgattgatctccttgccgaggaacaggttcgaggccacgtccaggttgtcgcagaactcctgcccctggaacaccgatgcgatgcccatgcggtccgcctccctgatcgagggaatggtcacctgttcgccgttgagataaatatggccgaatcccggctgcagaaatcccgcgatgaccttgatcagagtggactttcctgcgccgttatcgcccacgatggcgatgacctcctggcgctggatggacagattcaccgatttcaacgcctcgacgaagccgaacttcacacagatgtcctccagccgcagcagaggaggtgtgctcgaattcctcatggtgtgttccttcttatcactcttctcctggtaccggtcactggctgacgtcattgcgaaccgagaactcgatggcgcataatgcgccgcctagcgcgcaattgtcgtccgggtgggatgatacgagtacatcgatgggtgccacggcatcagggaacagcatgcgctgcaacgcttcattgaacggttggatgaatacgtcgccggtcatggccagcttgccgccgagcacaatgacctccggatccacgctgatgcacagatcagccgccacctgaccgatacgcacggccgcgtcggcgatgatgcgacggcaaccggggtcgccttcgttggcaaaggacaccagatcatccagcgtcatattgccgtgtgtgacgctgagcaactgcaccagcctgttttccgccacgacggtgtcaaggcagccgcggttgccgcacgaacagatggcacccagcgggtcgacctggatatggccgatttcaccggccaggccggtcacgccatgcatgatttcgccgttgatgacgatgcctgcgccaaccccgtcgttggctgagatatatacgaaattgcgtttgcctgccgccacgcccatacgggattcgccgtatgccgcgaaattcgcgtcattatcgacgtatacgggaacgttgaacgccgtgcgcaacggggccgtgatatcgacgccgtcccatccgggcagaatgccgggaatcgctatggtgtggtcgctggtggccaccggtgcggccacggccacgccgatgccgaccagctcgctggcttcggcgtcgatgctgctcagggtctcattgatgagcagcatggcgcgttccagcgttgtgtccgccttgtggcccaacggcagggggagcgtgtgctcagcgatgattgacttcgagaagtcaacgatagaaagcgtaagatgacgtcgcgcgatccaaagcccgacgccgaggccctgatgccgtgcaagggtcaccagagtggctctgcgaccgttgcgaacggtgtttttggtctccagctggtcttcgtcgacaagctgatggacgagcgtggacacggtcgcagtggacagtcctgtcacctctgccagttcgacctgtgtcatggcgccgaacttgtggatgctggccagcaagttggcgcggtttgcctcgcgaagcgaggtctgcgaaccgaaaagccttgttgccataagagttcagtgtagtcgttaccagcatgaggcacagcgaggcgcagagcgtggatttttcggcgtgtcgccttgtgatgcgcgaaaaatcgccattgcgttcattggttgaacataaacgacaggaaattcgctttcttgagtttgacaacttaactcaatacggtattctatgagatgaacctgaggttattcccaggttcgggcgaccaaggagggttcgccatcccctcgaagatgaaggagaacaaatgaagttcactaagaagatcgtcgccgtggtggcaggcgttgccatgtgcgcgggcctcgcggcctgcggtggcagccgtagcggccaggcaactggcggtgatgccaagatcgaaaagggcgccactatcggcatttcgatgccgaccaagtccgaagagcgttggaacaaggacggcaacaacctgaaggccaagctggagaaggccggatacaaggtcatcctgtccttcgccgacgataagccggcccagcagaacgctgacatcgagaacatggtcaacaacgacgccaagatcgtcgtggtcgcctccaaggatggcaccgcagtgggccccgccgttgagaaggcccgcgatgcaggcgccaaggtcatcgcctacgatcgactgatcatgaacaccgacgccgtcgactactacgccaccttccagctggagcaggtcggcgtgctcgaggccacgtggctcattgaccagctcaagcttaaggatggcgccaccggcccgttcaatatcgagctgttcaccggttccccggatgacaacaacgccaagtacttcttcaagggcgcttgggatctgctgcagccgtacttcgagaagggcgtgctcgtctccccgtcccagcacggtcagggtggcgtgaccaaggacttcaccgttgaggattggcagaagatctccgtgatgagctggaagaccgagcaggcgcagaaggacatggaatccatccttgactccacctacgcccacggcgagaagctcgacgcggtcctcactccgtacgacggcatcgcccagggcgtgatcaacgccatcgaatccaagcgtcccgacatgaagccgggcaccgactcctggccgtacatcaccggtcaggacgccatggagatcgcagttgccaacatcgccaaggataagcagggcgagaccgtgttcaaggacgtgaacaagctggctgacgccgtgtacgacatggtcgtcgagatcgccgagggcaaggaagtctccggcctgaacggcaagttcaacaacaacaacatcgacgtcccgtccaagctgcttgacccccagaacatcaccaaggacaacctccaggatctggtcacggccaactacatcacccaggatcgcttcgacgagctgactaagtagtcctcatcaggcaatccgtaaacaaacacaatgacatgcggcgcatagccgatatgcgccgcatgtccatgaacacagaactgtgacgaggagtggtgacatgtcatcaaatgacaccatcttgacgatggaaaacatcacgaagacgttcggtccggtcaaagccctcaccgatgtgaatctttccgtcgatcgcggcgagatccacgccatctgcggcgagaacggtgcaggtaaatcgaccctgatgaacgtgctttcgggtgtgtacccatacggtagctattccggcaaaatcacctttgatggcaaggaatgcaaataccatactattaatgattccgaggccgacggcatcgtaatcattcatcaggaactggcgttgagcccgttcctgtccattgcggagaacatcttcatcggcaacgagcaggccaagggtggcgtaatcgactgggacaagacccgtgccgaggcgaagaagctgctcgatcgtgtgggacttcccgaagacccggataccaaggttatggacatcggcgtcggcaagcagcagctcgtcgaaatcgccaaggcattgtccaaggacgtgaagctgctcatcctcgatgagccgaccgctgcactgaacgatgaggattccgcccacctgcttgacctggttcgtcagctacgtgacgagcagggcgtgaccagcatcatcatcactcataaactcaacgaggtcgccgccatcgccgacaatgtcaccatcattcgagacggttcgaccgtcggtgtgatgtacgtgacgccggagacgccgctcgaccaggaagaactcatccgcaagatggtgggtcgtccgctgcacaacctgtacccgaaccacccctccaataccccgggcgaggaatacctgcgtgtcgaggattggaccgtgcatcatccgctcgacgcggagcgcgtgatcgtagaccatgcgaacatcaacgtgcatgccggcgagatcgtcggtctggcgggtctgatgggtgcgggtcgtaccgagatggccatgtccatcttcggccactcttacggttccaacatctccggcaaggtgttcgtcaagggcaaggaagtcaagatgcccaacgtgcagtccgcgattgacgcaggtctcgcctacgccaccgaggatcgtaagggcaacggtctgaacctgctgcagaacatccgagagaacgcgtccctggcctccctgaccaagatcagcaagggcggggttgtggacgacaaccttgagcgcaaggaagttgaacagtaccgcaaggacttcaacatcaagtgccatgacatcgatgtgaatgtctccaccctctccggtggtaaccagcagaaagtgctgctcgccaagtgggttatctcgcagccggacatcctcatcctcgatgagccgacccgaggcatcgacgtcggcgccaagtatgagatctacgaaatcatcgataagcttgccgatgcaggcaaggccgtcatcgtgatttcctccgagctgcccgagctcatcggtatctgtgaccgcatttacacggtgtcctacggtgtcgtcaccgacaatgttgagaagaatggatttacccaggaatacctgatgaagggtatgaccaaggaaagggaggtggcagcctgatgagcgccgcaactgcaacacctgcaaagaaagaagaaaagaccggcctgctggccacggttgccaacaatgcccgtcaatacggtattgtcggcgcactgctggtcatcgtcgtggccttcgaggtcctgaccggaggcgtgctgctgaagccgaactccttcgtgtccctgattcagcagaacgcttacgtgatcatcctggccattggtatggtgatggtcatcatcgccacccacatcgacctttcggttggttccttggtagccttcatcggtggtgtgtgtgcactgctgatggaacgcgccggagtcaactggatgctcgccatcgtcatcgctctggtcgtcggcctgatcgtcggcgtctggcagggcttctgggtcgccgtcatcggcatcccgggcttcattaccactctggccggcatgttgatcttccgtggtctcgccaccgtgatcgtcggcgaatccgtgccgattacctccctcgaattccgtggcattgcccgtaactacctgcccaacatccttggctggtggggtccgttcgatggtctgaccattgtgctcggcatcctgtgcatcgtcggctttgcctggagccagctgcgcaagcgcgcccgtgtggccaaggtcggcctggtgcccgagccgatgagcctgaccgtcctcaaaattgtgcttgccgcggtcgtcatcgccttcgtcacctacctgctggcttcctccggtaacgctgatcagggtggtaccccgatcatgctggtgatcgtcggtgtgctggtcttcatctacaacttcatcctgaccaagaccgtgttcggtcgccacgtgtacgccgttggtggcaaccgcaaggccgccatcctctccggtatcaacacccgccgcgtggacttcctgctgttcgtccacatgggcttcctgtccgcagtggccgctgtctgcatgctctcccgtctggcttccgcaactgctcaggccggtatggagttcgagatggacgccatcgccgcctgcttcatcggtggcacggccgttaccggtggtattggtaccatcccgggcgctgtgatcggtgcattcgtgatgggtgttatcaaccagggtctgtcgatcatgggtgttgacaccgccgtggtgaagaccatcaagggcctcgtgctcctgctggccgtcgccgtggacatcatgtccaagcgcaagaagagctgaccttcccctttctcctcctcgatgtgggattcgtgccggtgccgctggtgcggatcccacactgttatctgccgtcattcttgtaatcaaaggactttttccgccatgaaactcaccgcgcgctccacctcccgtatgtatgcattgacctgcttggcctgcgttatctggctctggcagtcactggtcgaggccaataacgatggctcgctgttcaattgggccactattgtcttctcgctgtgcttgctagtggtcatcggatggagtggttggaatgccgtcgccgggtggaacgccaaggagactgaggccgccacggcaggtgccaaggatgatgagggcagcactgatcggtagcgtatatacggctgttgttgccggggacatataggtcccggcaaatctgcagcgatatgtgcattgcaagccagggattccctggcttttttatgtcgaaacggaactcgacacgggcgcgcaggccgttgggtttgtctagagcctgcatatagttacttatggtaatgactattggtaactaattggaggttgggccagcgatgtgcgattcccgaaccgataccaagaccggcttgcttccggtgaatgaggtgcggagcctcctggatgtctgctggaaggccaagaccatcaccgaactgatgccggcactgcccaaaggcctgaaaccgcgctacgtacacgtcattgatgccgtctggcatatcaacgaaacgaatgggcaggaaatcggcaccgcacgggtaagcgatgtcagcgcctttctcggcgtcactacgccgagcgttaccaaactcgttggcgagatggtggagcttggtctggtggtcaagcatatggatgccgccgatcggcgtgcggtgacgctcacgctcaccgagcgtggactagatatccgccgcgtttacgtagaggaataccatgcgcatcttagccagctattgggcgggctgaccgtggaacaatgcgaaaccactgtgcgcacattgaccgaagccctgcggcttatgcaggaagacgcgcagcatcgcaaaagcatgtgaatgaatggaggagagcaacgattatgactgattcagcaacacaactacctcacggcggcaaacaacccttttccaacaaactcgtcatcgcggtcgtctcgctcgcgatcctgaccttcctcggcatcctatcggaaacgtcactgaacatcgcctactccacgccgatggaggagttctccatcggcgcctcggtggtgcagtggcttgtcaccggttatctgctcttgctgtcggtgtcgattccgagctcgccgttcatggtgcgcaaattcgccaccaaaacactgttcatcatggccatcgtgattttcaccgccggcacattactgggcgcgctcgcggtcaacttcccgatgctgctcgccgcccgactggtcatgtcgctcggtaccggcatctccctgccgcttatcaccaacatcattctggagaaggcgccacttgaacagcgtggtgcgatgctcggcatagtcggcctggccacctgtgccgcaccggccatcggcccggtattcggcggcatgctgaagaaccacttcccgcccaagttcatccttagcggcttcgccggcaccatgattatggatgtggtgttcgttgcgctgtccggcaatgtgtgggtggtggccatcgccgcgaacgatggggcggacgcggccggttcgtatacggccgcgttcccgcgcagcatgatggtgttcaccggcatggccgtgcttggcgtgattctcgccgcgctcatgttccgattctccactcgccgaccgccggaattgagagaagtcaaatagtacgcccgcagcggattggttggctttatgatggaaccgatattccatcacaggagaagcaggggaactatcatgcttgatgaaccaccagtcactccgatccgcaaggccagtgacggcctcgaactgcccgccaccggcttcggtacgtacaaggtcaacggcctagccggtgtggacgccatcaagtccgccatccatcagggttaccgcctcatcgactccgcgttcaactatgagaacgaaggtgtggtgggtcgcgccatccgcgaatccggcgtgccgcgcgaagacatcatcgtcacgtccaagctgcccggccgccaccatgctcacgacgaggctctgctcaccattgaggagagcgtgtgccgtatgggcctcgactacatcgatctctatctgattcactggccgaacccaagccaaggccagttcgtcgaggcatgggaagcgctggtcgaagctcgcgaacgcggcttggtcaagcacattggcgtcagcaacttcctgcccggccacatcgacctgctcattcgcgatacaggtgtgacgccggccgtcaaccaggtcgagctgcacccgtacttccagcagcgcgaacagctgtcctacgacaatgcgcacggcatcatcaccgaggcatggagcccgctgggccgggccaaccagatgctgcgcgatccggatctgaagcgcatcgccgccaagcacggtatttccgtggtccaggccattttgcgctggcacctccaatacggcgacgtggccatcccgaagtccctgaacccggaacgccagcgccagaaccttgacctgaccgcttttgagctcgatgatcaggacatggccgatatcgccgcgatggacaaccccgaaggccacaccttcggccagaacccccactggcacgaagaagcgtgattccaacatgcaacgccctattatgacttcgcggtcgtttttgcgcacgccgtctgaagcggctgggcccggcgacgaggcaactattcaggacctcgtggatacgttggaggccaaccgttcacggtgcgtgggcatggccgccaacatgattggcgtgagcaagcgcatcatcgtcttcgtggacgaagatctcggtggccgtatcacggtgatgctcaaccccgtgatcaccgcttcggatggtgccttcgacgcccaggaaggctgtttgtcgctgaccggtgaacgccgcacactgcgctgccgccgtatcgaggtcaactacgaggaccgtcggttccgcgcccgccacgccaccttcaccggctggaccgcgcagatcatccaacacgaagtcgatcactgcaacggcatcatcatctgattcattcggtgctcgttgcagcccacccattaccatgtttggtaggccccgatggtcggggccgggtcgccggttccggtcggccacccccagtcggcaaaccggcagccccccccgccagcgggggcaaatttgtagctgccggccccgccaacgagcggggctcattcatatctacgcccgtgtgccggtttcaggcacggcagcagatagcttcgggtgcgcagccagatattcgtgcagcggctggttataggacatttccagttcaccatagttgctgcctgcacggaatgccgaatagttgtcgccgccctgcagcaggtaggagttggaggcgatgatcaccagatcgtcgtcagcgatcggcctgccgtcgatggtgaggtccacgatgccgacggtggccttaacccctgtatgctggttgccgtttccgtcggaatccccgagtgtgcatgtggcgccaccatctccgcactggacgtaccggtatcgcacattcgaggagatgccgagccatcggtgttccaattcaccgtcatcgttgcgatgaaactgctgggcgagcaccgccttgagtccgagtccggtgagggtttcgtgcgcggcgtggaactggagggccatcagactgtcgacctcacgaatcgtgaccttgccgtcctcgtccatatccagctgtttggttctcaggctgccatcgtttgagaacccgaccacgggcaatcgggtgccggcatacacattccgcatgatcgactcccggttggcgtccgccacaagcatgcccaccgatccttcatgtccgacggacgtgcgcttgtcgaaattcgttcccggcgccagagtgccgatcaccgcgttccccgccctggccgcgtagttggccttcgtgtcgagctgccgcgagcgcgctacgctgccgttcgacaccacgccggcggacatccaggcggcctgacgcggatgggcgtccagcccctccacgttgagcacgcccggaaccgcagtggcctcggtgccgttgccgaggttcacatcggccacctggaccttggcatgacgaccatggccggtgatgatcagatcctgcacggccatgttctggccgaagctaccggcctcatagatcggtgcccctccgtcggtgacgccttgttttacggcgtgggtgtggccggtgtaggcgaggtccacatcacgtccgagaccggttgccgccgaggcgtcggcgtgcaacaatgcgaccaccgcatcgactttgcccgaacgcttcagttcaccggccacgcggttgagcgcgtcgacggcacgttcgctcagatcggcgtcttcggtgatctgcggcgtggccaccgagccaagcgcgtccgtgagcgcgcccacgaaaccgatgcgcttgccattcaccgtgcgaatcgtatagtccttgacatggctcagtttgccggtagctgatttattggccgaggacacgttggcgcagagccagtcgatgccgttggccggagcggccacacgattgttgaagtcggccacgctgcgatcgaattcatggttgcccacggcagaaaccgtcagcccccacaccttggccatgtcaagggtgggtttgtcttgcctcacggccgactcatagggcgatccgcccaccagatcgccggtggagacgggaaccatattgtcggggttgtgactgtccgccaaggtgaaggcggctgcgacatcggccccatgttcgatatgaccatggaaatcggtgatgtcggcgatggtcaccgtgcgtgtgccggtggccggatcctcgccggaaaaaggaacggctcctgcggcacccgcgatattgggtgccacaagagccgtcatcatgatgagcgcgacgatgacgcccatcgttctgcgatgtctgcccgccgtgaaccggcggcggttcgtgtccctgttcacgctttcacggtaaacgcgcaggttgaaccgcatgggcttcgcatttggccggcagatgaattcccggttatttccgcccacagcgtctggccgaatcgggccgtcttcgttggttcggcggtgccattcgccaagctcggcggcgcagatggcggccacagcggcgtgttccgactcgcgggagccgaagcacgccgactcgtttgaccgcccgacgggccttagacgggccttattcgctggcgttcagagacatacgaggagccatatgctcggcgaagaagctcagcatcgattcgacggcctcccgggtctccttgagccaaggcatgcccacgatgtagttatggggcaggcattcgcgcggagcggcacgatagtccagcaactcatggtcgatgcccagcttgcgcagctcgacacccagttcgaggctggtggcttcgaggaagtcatcagtgctcgtggccatccagaccggcggcagaccagcattcacgaccagctgagcgagcctttcgaacttcgtccccttcacacgctcaacatagcgcgtgaaacacggagccagctcctcgacaagcccaccggcatcataggcgttctcatcgaacagccggtccagatcggccatcgcggatttgagacccaaggccctcagaccaagcttcgcgggatgcacgtcgagcagggaagcatattcgtcgttgttcatggcggccgtcagatgcagcaccaaggtcacacccgccgaatccccggtaaagaaaacctggttcgtatccagcagatacctgccggaggatttcgacacccactccaaggccgaggccaagtccctcagctgcgtgaggaagtccaccgcgggatacaggggatagctcacggacaccacggcatacccatgacgggcaagctcgatggcatgcgagcggttaatctccttgaagccatagaagtacgcccctccatgaacctcgaagatcaccggaacagccgctccgccacggaccacggcatcacggggcaacagcacgtccaacaggtgtccacgcgtcgcgtccggcagatatgggatgtcgccatacagcaccacatcatccggaatctcacgcttgaatgcataccgaggcaggtcgttatgggcaaaattcgtacgatgctggagcacgtcagcagcgatggccggatcgacgccctccaaatcctcgtcgaaatacgtccaggtttgcgcgaccttcttctgttcttcggtcagaccgtcgttgcgctcgaaaaggaatgcgtcggcgccttgcagatcggtgatcatcaaatctccgccttcatatcctcaagctcaacgccgttggtctcgggcagcttcttggcgatgaaccagtatccgaggacggccatcacggcgtacagggcgaaggtccaagtcaggccgaggctatcacgcagcggcgggaaggtggtggagacgaggaagttgccgatccagttggcggcggtggccagcgccaccgcaacggcgcggatgcggttcgggaagatctcgccgatgacgacccacatcgccacgccccacgtcgcgcaataggtcaggaagaacccataggcgccgataatcatgatgatggcccacgcaccgggcagctcgatgccgccatcggcggtcatcgtggattgggcgaagcaaacggccaccacgaccagaagcacagccatgatcagggacccgaccttgagcatggcgcggcgaccgaccttatcgatgatcagcatgccgagcacggtgacggcggtggccagcaaagcacgcaccacagcgatggtcatagacgcggactcggtgaaaccgacagccttccacaggctggaatcgtataacatgatgacgttcgcgccggacacctgctggaacagggcgacgccgatgccgatccataccacggatttgaggccgaaggtcttgccgcgcagatcggagaccttgggctgcgtctcgccttcgaggctctgggcgatctgctcgaccgtcgcggaggcgttgcggtcgcccacgacttcgagaagcaccttctcggcgatggccttcttgcccttcatcaccagataacgcggggattcgggcagcgcgaaggtgagcgcgaacatgatgacgcccgggacggctgtggtcatcagcatccagcgccaagtctcgagtccggcccagaacgtcacggcggcgccgcccgagccaagaagataggagtcattgaccacaagggaggccacgatgcccaaggcgatggccatctgttggaagccggtgaggaatcctcggcgtgacgacggcgatatctcggagatataggcggggccgatggctgaggtgaatccgacgccaagtccgcccacgatgcggaaaatcacgaacacccagatattggacgccagaccggtgaacagggcgctgaatacgaacagcgcggcggcaagctgcatgacgcgcacacgaccgatgcgatcggccagcgtgcccgcgaaccatgcgccgaccacgcagccgatcatggcgctggacaccgagaaaccgctcatggcggcgttcaacccgaagccggagtcggggctggcgatggcgtccacggcgccgttgatgaccgaggtatcatagccgaacaggaaaccgcccacggcgccgatggtggcgacggtgatgagcttggcatgcagtttcgttggcacttcattgttttgattcatggattgcctcctttgcctttcatgaacctggttcgatgatagaagcaattcggcgggatggcatcggtggactgtgacctatcagggacaaagtgtgacctatggtgtgacgccttcgtcacagagccaccagttggaagacgctcacaacgattccgttcaccggcccttcttcgaactggtccgtcaatcgtcatcgcagttgtgcgagagctcgatgtcacgccactgcccgggcgtgagaccaaatttacgctcgaaagccgcttggaaccccctttcattgggaaaaccagccacccgtcccacttggccgatgtccgcatcgggcatgcgtagccgttcgcaggccactttgagtcgtaactcattgacgtaatccataaacgaagtgcctgaatattttttgaaaagccgggagaaatactcacgcgaatatccgaagtgccttgccgcttcgctggtagtgatggacgaaagaaaatgatcccgggcatagcgataaatcaacgatatggactgactgtccccgtcgtcaggtccatcaatcgccttcgactgcatgaagtcgtcgaatatcctgcccatcaacgcgaagaacgcggcattggcgttcacatacttcacctgggatacgccaacaagctggtcgtatatctcatcgcataacggggcaaaggccactcccccatgcctgttgcagcggtcatagtccacttgacgctgcgcctgcagaatccgtggaaggaatgcggacatctcaaccggattgaccgtgacggacaacgcctgcggcgtggtcccccggtcctcatccttcaccatgtgaaccgcatgcacggcctccggcggaattacatgcgcctgtcccggctgcagcacggtcatggcgccattcactacgacggacatggggcagtccttcgcgtacagcacctcaagaccgctatgccagtgatatctcgctttgtcatagctttgatgggctatgaccagcgccggaaactgcgtcgttgataccagcaactcctgcttggagtcatcgacatagcgcataccgcatcctttctccgaatggatatcatctccgaatggatatcacccaaccatgttccatcatcgatgtgctcatcgtatcgacgatccttgccgcaaaacatgaaagccagtcatccggccggctttcatgttggagggaggctacgctactcggcatcgttggaaacgggaccatcgttcgacggctcggactccgtttccgcgggagatcccgcctctccatcgaccgcagaaacagaatcccccgtctcggcctcaggctgttcgaaggtctcgcccttgaaggtgaactcacccagcagaccttcgccctcggcgtcgacgataaccttctgaccgtcttcgagatcgcccatcaggatcttctcggagatggcgtcctcgatgtcgcgctgaatcacgcggcgcagcggacgggcaccgagcagcgggtcgaagcccttctgcgcaagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacctaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcaacgtgttgaagatgtccggatgagccttttcgatctcgtcgaacagcaccacggagaacggcttgcggcgcaccttttcggtgagctcgccgccttcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgaaccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcaggttacggtcctggatgtaccggctggacagctctgcggcagactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtgaatctcgtcgatgaacagcacgatgtcgccacgagtcttgatttccttcagcaccttcttcagacgctcctcgaaatcaccacggtagcgggagcctgccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggaaagcacgaccataacgcgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagccctgcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacccggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcacctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccgtccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccagaactccaccgaggtgaacggaatgccgaggctaatcttgggaatcagcacggcgaacagaccccagaaaatgagctgcgtgtacacaggcgtgccgcggaagaaccagatgaagaaccagctgacgccgcgcagcaccggattgatggatttgcgcatgatggcgagaatcaccgacaggatgatcgccacgaccatggagatcacggtgagctccaaggtatagcgaatgccttcaagcacgttctcgttgaacaggtacttccagacggtgggccaatccagtcgcggattggtaatcaagccttgaatgagcatcgcggcgagcagcaccacgatcactgcggccacaatcgggccggggcgcttgaccggcagcgccttgatgcggttggggatgttcactccctcaccgtcgacttctttcttcgccataatttggttccttggacgtgttgggcagcctgaactgcaagttgcaactagcgttgaaccttagtgtacgaatggggcgactgtgttacaaacagtgcgccccattcgaattttcgcgacagcttgtcggctattcgacggccgggttgatttcggccttgtccagtgcgccggattcgacgccccagtgctggaggatcttggtgtaggtgccgtcgtccataagcttttgcatggccttctgcacggcttcggtggtctgggaatcgccctttttgatggcgatggcgttcggcacttcatcgaagtccttgccgagctgttccagctgaccatcggtctgggcaatggcgtagccgacaaccggggaatcggcgaagaagacgtcggccttgccggtcaccacagcggtggtggcgtcggtctgctgcttggaggactggatggtgatgtctttcttgccgtccgccttgcactgcttggcggtcttgttgatggcctcttcctcgacggtgccggtctcgacggcaacgttcagaccgcacaggtcgttctcatcgacgttcttggggttgcctgcggccactgcatagcccatgcctgcggtgaagtaggagacgaagtcgacggattccatgcgctccttggtgatggtgaaggcggcgatgcccagatcgtacttggagccgatggccggaatgatcgtatcgaagttggaggagacgatttcggtatcgagaccgaagatgttgcccatggcgcgggcaagatccatgtcgtagccgatctgggtcttgccgtcggcgtcgaggaattcggccggggcgtaggaggggttggtgccgatggtgagcttgccgtccttggtcacggattcaggcagcagtgcggcgatggtgtcatccttctccacggagctgacatcgtagctggtgatggtggcggcatcggagcccttggcggaatccgtgccggcatcggccttgtcggaggtgccgcaagcggcggtggcgaacagcatggccgagctcagtgcaatggccataatggacttcagtttggtggactgcataatcgtttcttcttctctcttacgccgcttcaacggcaacgatcaacggttaagcatatttatacactacagtgcatacatatacaaaaagactcccgccgcagggcaacgggagtcttcatagtaaccgaaactactcgacggacgggttgatctcggccttgtcgacggcgccggaagagacgccccacgtgtcgaggatcttcttgtacgtgccatcatccatcagcttctggatggccttctgtacggcctcggcggtcttggaatcgcccttcttgacggccacggcctcaggagtcacaccaacgtcctcgccgagggcctcgagcgtatcaccggtctgcttgatggcgtagccggcaaccggcgtatcggcgtagaagatatcagccttaccggaagccacggcggtagtcacatcggtctgcagcttggaggactggatgtcgatggcatccttaccgtccgccttgcactgctcgttatccttgttgacttcctcttcctgggtggtaccggtctgcacagccaccttcacgccgcacaggttcgaggagtcgaccttgttcgggttgcccttctgcaccacgaacgtggaaccggccttgaagtaggtcacgaagtccacagcctccatgcgttccttggtcacggtgaaggaggagatgccgatgtcgtacttggagccgacggacgggataatcgaatcgaacgtggaggagacggtgttttccttcagtccgaacactgcggccagcgccttggacaggtcgacatcaaagccgaccggggtcttgccgtcctcggccaggaactcggccggggcataggaagtatcggcgccgacggtcagcgtgccgtcgccggccacggaatcgggcagcagtgcggcaatctcgtcgtccttctggatgctgccggtgtcgaagccttgaatcgaagtgctggacgagtccttggatgaatcgccgctcttggatgcggtgtcggtgctgtcagtcgtgccacaggccgccacggcgatcagcatggccgcgctcagggcggcggccgcagcggattgtattcccttgcttagagacattggatttcctctctccggatagtcagctgggcgggtatgtttcccagatggttccagagcgtaggagtgcaatgctacggaagcgttaatcgtgggcgaaatggcccacaacgcggacatcctactcttggctcccctccggaggggagccaagaggcgggactagtggcgcatgttggcgtagcgcatggcgcgtagggcttcgcgcttgtcctgctcttcgcgcagggcctggcgcttgtcgaattccttcttgcctcgggccagcgcgatctccgccttgacgcgaccgtccttgaagtacaggctcagcggcacaatcgtgtatcccttggcttcgatgccgcgggcgagcttggtgatctgcagtcggtgcagcagcagcttgcgcttgcgcttgggcgcatggttgttccatgtgccgttcaggtattcggggatgttcgcgccctccagccacatttcgccgcggcggtcgatggagatgaacgcctcggacagcgatgcgcggccttcgcgcaacgacttgacctcggtgccggtcagggccagccctgcctcatacttgtcttcgatggcatagtcatgccgggccttcttgttctgtacgatgagtttctcaccggtttccttgggcatgtctcctcctttcgtgggcaataactcgtgagtagcaactcgtgggtagcaactcgtgggtagcaacgcaacatccgacgatatcacggaccggcctcgaatacgaaaaagggttcctcttcaagaggaacccttcaaccgcatatatcggccgaaccaaccggtcagtggacgaaccagtactgacccaaattggtcagcgtgcggtagttcatcatccacaggccgcccacgttcatctcggagatctggaatgtgccgtcgccatacacggcttcaaccacggcaacatggccccaggtaccgtcggcaccgtcctgaccaggcaggaaggagagcgcggcgccgacctgagggttgtggtccacgcgcaagccgtacgagggggcgctgcgccaccagtcgccgccattgccgagataggacggcgtgccaatgcccatctgcctacggcgttcatacgcccagtacgtgcactggccggcggcataggcgttgccgtaatcaccgttcgacgtgccttggccgccgacgctgggggcgggggcgggggccggcgccggcgccggagccggagccggagcgggcgccggagcgggggtcaccggagtggacggcgtgccgccctggttaccggtatccacccggttggcggcgtcctgctgctccttctggaactgacgattgtaggaatcgacctgggaagcgatcagtacggtccgggccgcctgcttggcggattgggaatccagactgtcgatcatggaagacagttcgtcacgccttgcttcgccttcctggcgcagcttatccaaagcgtcacgttcgctttgcgcggtttcggcggcggtctgtgcggaagcggccttctcatcggcctgggtcttgagcacagcgatctgcttttcgatggccgccaagcgctcgccacggttcttcgacgtgctcagtgaggtcgcggcggaggaagccgcattcgcctcgttgcgggacaacgcgtcccgggactgcatggagttgacgaagtcctgtgtgctggtggcacccgtcaccacgctcatcacgtcggaagcattcgagccgtgcatctcgtcacgggccagctgggccacggcggcgtgcgcgtcatcgtagtccttgccggtctgcttgatctgctcctcgagcgtctccttgtctttctgcgcggcggaaagacgtccggatgcggcatcggcctcgtcctgagcggtggcggcatcctcgttggcctgtgtgaccttggcctgcgcggcgacaatcttgttgttggtcagatcgtccagctcaagtaccttattcgccaggtcctggctggcaccggccagctgctgcttgagttcggcctcgcgctgtaccgacgcggcgtgctggttctgcgcattgatcaggtcggaataggtgtctgcctgggcaggctgtgccgagctgaacgccagacctcccacacaggccgcggcggccaccagtgccgccagtgcgggcttgatcacacgtacgttcgtcatatgtgaatagtcctttcgctcacttaagccaataccataacatgcgaacctgagaggcttgcacacgatgtcatcacatttctcgcgggtaagccggtcgcgttacgccctcaaataacgccgcaacgagatggttgaagcgatgatggacagcagtatcgcgcccacaaccaggaacggcgatatcaccagtaccgtgagctgattcacataaggaatccatgtaacggatttcgccagccagccggtgacgaacacgttgacgatagccgaaagcatcaggcacgagagcaccgagccgatcagcgaggcgatggtgccctccagaatgaacggcagacgaatcgtccagttcgaggcacccacgtacctcatgatttcggtttcggttcgtctggatgcggcggacatacgaatggtggttccggtcagcaggatggcgaccaccaccatcacgccggcgagcacagccgtaaccgccgtggctcggttgagcacggcgaacaccgggtcgaagatctggcgctggtcggtgacgtcttccacaccctccttgccagagagcacttcggagaccacctgatatttggtggggtccttgagcttgagccagagggagtcctgcatatcgtccgcggtcagcgtacggccttggaattcaccgttcgggtactgcttggtgaaggtgttgtcgtagaaatcctgcttgctgacatagtcgatgttggagaccacgtcgttgagttcgtcgcgaatggttttctgcagtgccgtgatctcattggctgagggcgatttgccggaagcgcagttcgcggactggctggtgccgtcggggcatagccataccacgacctcgaccttgtcgtaccagtcgcccttggctttggtgatctgcgcctgagtaagcaccgaagcgccgatgaacaggaatgagatgaaggtgaccagcgtcagcgacagcagcatcgacaggttacgggtgaggttggcccacgtttcggacagaatgaatcgtgctcgcatgatgatcccccttactccttcgcgccctcagcgggttgatcgtcggatgtttggtctgcggcggactgctcgtcagcaggctgctcggcggcggactgctcgttggccggcggtgcgggcggttccggcggtgcgggcggctccggcggggccggcggctcggcggtggatgacacggacgtatcggcaaccgcggcggtcgcggcggactcgtccttgaacgggtcgaacgcctgggtgctttccagggcggcggcctgctcgtccagcggaatgcccttgccccaggtcagcgtgtcttccagcggcgcaaacgtctcgccatagcggccggtgcggccggaatgcacggaattggccaaacgggcgatgccttcagacggctcgtcactgccctcgatggccttggtcgccgccgccagcacatgatgggcggtgtcggacttggcttcgacttcggcatccgggaagaacagggcggaatcgtaggagccatgagcctcgtcacgcacgatcttgccgttgtgcagttcgaccacgcgcttgcgcatcgagttgacgatctcttcgttatgcgtggccatgacgatggtggtgccggtgcggttgatggcgtccagcacttccatgatgcccagcgaagtggtcgggtcgaggttgccggtgggctcgtcggccagcagaatctgcgggtggttcacgtaggcgcgggcgatggccacacgctgctgctcgccaccggagagctcatgcgggtagttcttttccttgccggtgagccccacggtattcagcaccttgggcaccaacgatttgatggtggaccgccgtgtgccgatcacctcaagggcgaacgccacgttctcccatacggttttgttattgagcagcttgtaatcctggaacacgaagcccagcgaacggcggtactgcggcacttgacggttggtgatgcgccgcagatcgttgccggccacgcgaatctcgccgttggtggcctcttcctcgcgcaacagcaggctcaagagcgtggtcttgccggagccggacgcacccacaaggaacacgaaatcaccgcgttcgatatcgaggttgatgtcgtcaagcgccggtcgggtgcctttgggatagatcttggacacattgtccagtgagatcagtgccataatgctgtttactcctcggtttcggcggcgcggcgctgttcgtggcgccagcggatgccggcctcgatgaacgcgttgatgtcgccgtcgaacacggcctgggtctggctggtttcgtagccggtgcgcaaatccttgaccatctggtaggggtgcagcacgtaggagcgcatctgatcgccccagctggccttgatgtcgccggcgagctccttcttcttcttggcctcctcctcgtggcgcagcacgagcagtcgggactggagcacggccatggcggaggcgcggttctgaatctgcgaacgctcatcctgcatggtcaccacgatgccggtgggaaggtgggtgatgcgcacggccgagtacgtggtgttcacgccctggccgccggggccggaggagcagtaggtgtccacgcggatgtccgtatccggaatgtcgatgtgatcggtggcctcgaccagcggcaccacttccacggcggcgaagctggtctggcggcggccctggttgtcgaacggggagatgcgcaccagacggtgggtgccgccttccacggacagtcggccgtaagcgtagggggcgtccacctggaaggtggcggacttgatgccggcctcttcggcgtaggaggtgtccatgaccttggccttgaagccgttacgctcgcagtagcgcaggtacatgcgcagcagcatctgcgcgaagtcggccgcgtcgacgccgccggcaccggagcggatggtcaccacggcggaacgttcgtcgtattcgccgtcaagcagggtctggatctccatctggtcgagatccttctggatctcgccgatttcgctttgcgcctcgtccagagagtcctggtcgccctcctcgtggccgagttcgacgagcgtttccacatcgtcgatgcgctgggaggcggagttcagacgcttcagctgcgattccgcggcggacagccggctggtgatcttctgggcgttttccgggtcatcccacaggcccggggccgcggcctgcgtttcgagatccttgatatcggccttgagtcggtcgacgtccagcgccttggcgatggattcgtatttggcgcgggcttcgccgatcgcctgggtaaagtcaaattctgccatcgtggtttaccttactgttgattctttgagattctttgggaagtcacgtccttgttgacagccttcgcacattcctctggcgttggcgggcattgccgcgccacacgcgcatccgcctgcaatccatgctgtcagaaggttccgggcctgccttgccgatagccggccgggcgacctcacgaatccctcgcatcagacgtgttcaactgcgggcacgaatatgcgaaggcaacgtcaaagccccgcgtaaatcgccgggatgatcagggagccgagcatggccacagctatgaccacgcacaccacacgcacgatggtgcggcggcggttctcacgctgctgtcggctgtcctgatagttactcacgagaccaatagtgtactcaccgcttacgaccgcaggacttgccgccgacgcccgccctgccggtggacccccacggccctttcctttgcgctttcagcgccgccagatggtgtttcatggccaccagcatgatgtgcgaatcctcaaggcccaagtggcgttcgttgtgggcggaatcaagcgcgccctgacgtttggcgtaggcgtcgagcgtgttgtctccgtaaggatgctcgttggtgggtaccgcgccggggtcccactgccggctcatcggcagggtatcgatgatggtgatgcgcccggcgcggtagctttccgcgtatccggcgacgttcagcatgaaccagctatgttcgaaggtggcgttatgcgccacgtacggctgctgggtaagccgcgcgagcaggccggcctgggcttggggccattcgtcgaagagtcggtacccggcctcgctgctgcggccgcgtacatcgatgccggtgagtttggcgatgagggcgttgccgagcgccgcgttttccggcggcacgccaaaagcgaggcgggactggccgtaggcgtcgccggcggcgtaatagccctgctcataggcgtatgtctcgggttcgccggccgggcgcggactggccatgttcatgaactcgaagccgacgtcgatgatgtagtcacgtgccggatcgatgccggtggtttcgatgtcgatgcccatcaccgcgtccacgtcgcggccgggcaggtaggcgtcacgccagtcgggcttgggatggtgtccggtagcgttgccagacgcggcggcaccacccggcagagcggcaccacccggcgaagtcgcgccggagagattggcgcgggccatcgccgcatcgcccgcacgcttctggaagcgctgggccttacgtcgttcggcgcgtgcgtcaagaatcgccgccgtacggtcttggatatcgtccaaggcgactgttgtggggaacttgacatcgctgttttcggcagcagtgtttccggcagatgcgtcaccggtttcaccgctcagattcagcatgccttggtcatcgttcgatgggcggctgccggagtacggcctgagcacggcaacggtagtcctcccccgccgttcgcgactgaccacccataggtgttgctgttcgcccagatgcaacagcgtgttgatgttgtcgttgagccgacgattggcgtaggcgagcgcgcgaggcagacgataggagccgatgaatcgatcgtaatcggtcatgaatgtgctgttgcattgggcgatgattgattccagatgctcgcgtgtggcgtagtcggccttcaatgcgtcgtggatggactgtggggtggattccggtattgtgccgacgccatgcgccaggtccagagaacgcacccagtcccagtcgatggtggtgccatcggcgtccttgggcatggacgccgcccattggggaatgtctcccttggcggcgtcgaaccatgcacggtcggtcatagtgcgaaaccgagctcttcagcggcctcggtgggcaccgggtcttcgcaccagtagtcctcgaggttctcgttggtggtcagcgaacggatttcggcgcgatcgatatacaactcgccgctcaaatgatcggtttcgtgctggaagatgcgtgcgggccagccgtgcagcggctcgctgtggtgtttgccgtcttcatcatcccattcggcggtgatgtcgagccaacgcttgcgcacagcttggtatccgtcgaagctcaggcagccctcgtagaacgaggcggttttgtcgctggtgggtttgtagctcgggttgatgatcacgtggaaggggaattccgcgatttcgcgcggatcatcctcgtcgtcgcgcacgtggtcttcgaccacggcgagcgcgagccccaagccgatctgggtggcggcgagccccacgccgggtgcctccagcatggtggtgtgcatcgtatcgatgagtttggcgagcgtacgcttggaaagctggccattataggccactgtccgttggcgcaacaccggttcgccggcctgcacgatgggcaggagcttctccttgccgccggttttgatgagttgttcgacatcacggttgagttcgaggtcgactttggcgttctttccaaacattgtttttttccttagggaagggtgctacagcgcgagttcttcggcgacgatcttggcgaggcgggtgcagacttcgtcggcgtaggcttgggtggcggcctcggccatcacgcgcacgagcggttcggtgccggaggggcgcagcagcacacggccggtgtctcccagcagttcctcctcacgggccacggcatcctggatgcgcttgttggtggaggcggccttcttgtccacgttcggcacgttgatgagggtctgcggcagctgcgggaagtcggcggcgagctccttcaggctcttgccggacttgacgacctcgttgcacagggtcagtgcggtcagggtgccgtcgccggtggtggcgaattcgcggttgatcacgtggccggactgctcgccgccgagcgagtaatcgcccttgagcatttcctcaagcacgtaacgatcgcccacggcggtttccacggtcttgatgcccatatctttcagggcgagcttcagaccgaggttgctcatcacggtgaccacgagggtgtcgtggttgagcttgccttcgcgctgcttggcgcgggccagaatgcccatgatctggtcgccgttgatcatgttgccgtcttcgtccacggcgagacaacggtcggcgtcgccgtcgaaggccacgcccatcacggcatcggtggccttgaccatggcctgcagctgctcggggtgggtggaaccggcgttcttgttgatgttgtagccgtccggcgaggcgttgatcacgattacatccgcaccggcacggcgcagggcttcgggagccaccacggaagtggcgccgttggcgcagtcggccacgatcttcagtcccttgagcggcttgggctgggttttgtcatcgttcagcggagcgatggtggccaccagatgatcgatgtacaggttggtggcagtggtctggtcgtggctcacgcggcccacgccggcaccggtcgggcggtcccagtcctggccgagcacggcctcgatgtcgtcttccttctggtcgggcagcttgaagccgccgcgtgcgaagaacttgatgccgttgtcgggcatcgggttgtgggaggcggagatcacggcacccatctcaacgttgagcacgctggtcaggaacgcgatgcccggggtcgggatgatgcctgcgtcgatcacgtcgaatccgccggcggccatgcccgcagacagggcggaagccagaaaatcgccggacacacgggtgtcacgacccacgagcgcgcggcggcgcccctcaggctgatcgtcttgggtgccggcgtcgccgagcacacgcacggcggcatcgcccaaatccaacgccagacgtgcggtcaaatccctattggccagtcctcgaacaccatcggttccaaacatcttcggcatatgaagttccactccttgtatcgcgttacccgcaccatcgtagtcgttgtgctccaccctaggacccgactcggcaaaaaaccgccacggaatctgctccagaaccggaaatcagcattcaacagccgcaatggcatcacccacaaacccgcatattcatcttgttcggcggatgaatgatgagatacattcgttagcgggcatgccgggcggaccgatgcactccggcacgggaacgaagccatcgcactagtaagaacgggccggcaaacgcgcctgtaaacaatacagcggcaaatacgacgaacggaactacccagcgtacatcgataaccggcaaagcaacaccaaacagaacgacggcgaggaacacgctgagccatgcggtgaacatgcccaacggcatctcctctaccggagtggtctcggctatgcatgcaacgatctatcactccgatgttgtggtcagtatgcgcggcagttgttcgtcacggttgaggaaagaacgcgtttggcaacgaagtagcgtacgccggccttcctcagtgcgggtgtataccatggtgcaatgcgtcaggcagcggtccaactgccggcgcagtatttcggcgtcctgctggcggcgggcaaatatggacgggaatgggaagcttacaccgtacgtgcgcacgccccattccttgccgatgatgacatatcgcggattgttgatgggcgcgagtagctccttcataacgccggcgaacagcacctgctcgcgccgcgaaccaccaatcagcatggcacgcaacgccgtgaatctgcgacgtgtctggcggatcgaggaagtcactcacctctttgcctaccgcgttggtttctaggcgctcaggttccgcagtcgccaaatgccagacattggccaccttatcggggtctgcggccacgctgcggttggcggccatgctgtatgcttcactgcatcagtgtaaggcatgaatcaataggttttgagccccagatcgatggtgagaatgatgccggcgattacggcggcggcgcgcatgatgtttgcgggaatcttgcgggtgatgggcggggcgatgtacccgccgatgaagcagccgatgcacagcatgatggcggccggccaatcgaccgcgccttggatgatgaataccactgaggcgctgatgttcgcgcctgtgccgatcagggttttcaatgcattgatcttgtggaatgggccgattttggcggcatcaagcatggcgagagccagggtgccggcgcccgcgccgaagtagccggagtagatggcgactgccaccacgcccagccatacccaccaggaatcctggctcatgggctgcacgagttgttccggcgggcggtgaggtgcggtaggggtggttgcgcgcttggcggcatcagtggcatcggtggcttcagtggcttcgatgtgcttgagttgcgcggtggcatccgcggcggcctgcttggcctgcatgcggccgcgcggattgatggcgatgatcagcgagctcagcaaaatcagcactggtgcggcgaattcaaagacactcgggtcgagtttgagcaacagaaacgcaccggccaccccgccgaacgcgccaatgaccacatacgtaatggagcgtaccgcttggcctttgagttctttgcgcgcgcccatcacgccaccgatgcccgtgccgaccacgccaacggtgttagaagcgtttgccaatacaggcggaatgccgaacgcgagcaaggccgggtatgagaccagtgacgatgcgcctaccgcatagcccacgaatcctgcgccgattccggccaacagaatcagtagtaatgaagttatggaaaagcccgcaatcattccccgtatccttgtcgctcatcgaccggcacattgccggccttgagcgagaatacgctgttgaggattggttgcgggttttatgttggaatgtggacgtagctcctcgcggaagcgattcccccagtcgcctgaggcgacaactcccctcgcacccgaggggagccagaaggaaatcagagcgcttcgttgtattcgcgaaccttgagggtgcggtgggaggatgccacgttttcgacgatcagacgcttcagggcgttgtcggcggcaatgtgctcgtccagccaggcgtcaccgagcttgaccagcgtggcgggatcggcgtaacccgggtacaggccgttgagcaaagcctcggccatgtgataggtcttgttggcccagacccagtccacagtctcgaagtacttggcggcgaacggctcggccagatcggggcgcggggtggcggagaagccacgggccacggcttcgagctgggagttggtcagctcgtcgttgtggagtgcctgatcccaagcccattccttggcttgcgtcgtggccatggaggcgcgggcgccgtaggcgaactcgcggttttccgtggtctccttcttggcgagctgcgcgtccacgtcgtcgttggtcatctcgttgacggaggtgagcgcttggacgatggtccacgtgaagttgttgtcgatttcgaggccttcaagacgcacggtgccgtccagcagaccgtgtgcgttggcggcgaatgcggcatcgccctcctcgccatagcccaggtaggcggtggcgagctggaactgggtgtccgagccggcttcggcggcgttggccagggtccacagctcggcggccacgtggcgcagcacatcgtcgcggcgggctggcgccacgtagtggtgggcggtggtgcccatgcaggccagcgcgtaacggaaggtggtggattcggtttccgtggccagaagacgcagggtcatgtccacgaagcgttcggccgggaattcgccgtcacgggtcatatcccagaaggcgagccaggtcacggcgcgggccagggcatcgtcgaaacgatgcaggttggcttcggcgaatgcctgggattcggcgtcgaaacgaatcttggtgtaggtcaggtcatcgtcgttgaccagcacgaatgccgggcgcggcttgcctgccgcggcctcgacgatggtggtttcgccatccacgtcgagttcgaactgctcggtgcgcacgatcttgccggtttcggcgtcttcgttgtagaagccgacggccaggcgatgcggacgcagcaccgggtgttcggccggcgcgctctgggtgagcttcaattcggcgatggtgccgtccgcgtttacggtcaggccggtggcgatcgtgttgatgccggattcctccagccacttggcgctccaggccttgagatcgcggccggaggtcttctccagttcgctcagcaggtcggccagggtggcgttggagtaggcgtggcggttcaggtagttgtggataccttcgaagaactgcgtgcggcccacgtagaatgccagctgcttcagcacggaggcgcccttggcgtaggtgatgccgtcgaagttgacgtaggtgtcgttgaggtcgttgatcggggcgacgatcgggtgcgtggtgggcagctgatcctggcgcagcgcccagctcttctcgccggagcagaaagtggcccaagcgtcatgccattcggtggcttcggcagtggccagcgtggaggtgaattcagcgaaggactcgttgagccacaggtcgttccaccacttcatggtcacatagtcgccgaaccacatgtgcgcaagctcgtgcagcacggtcaccacacgacgctcggccagcgcgtcggtcaccttggattcgaacacgtaggagtcgcggatggtgaccatgccgatgttctccatcgcgcccgcgttgtattcgggaacgtagatctggtcgaacttggcgtacgggtagggcacgccccaggtcttggcgtagaacgcgaagcccttcttggtgatgtcgaacaggtagtcgacgtccttcgcgaaggccttggccaacgactgtcggcagtactgggccatcggcacggtgcgaccgtcttcgttcaggtattcggtgtgccattcggcgtacgggccggcgcagatggcggtcaggtaggagctcatcaccggggtcggctcgaagtcccacagacgggtgctttcgttcggcttgtcgccgagggtgccgtcgagggtttcgcgcggatcgtcctcgatggtggcaaccggcatgttggaggtgacgatccagctggcgggagcgagcaccttgaaatcgaaggtggccttcaggtcaggctggtcgaacacggcgtagacgcggcgcgcgtccggcacctcgaactgggagtacaggtagatgttgccatcggacgggtcgaccgagcggtgcaggccctcgccggtgttggagtaacggcacttggcttcgacggtgacctcgttcttctccttgaggtcggtcagttcgatgcggttgtcctggaaggccacggctgggtccagggacttgccgttgaggtcgatggatgtcacttcgtcggcaatcaggtcgaggaaggtcgacgaaccaggcttcgcgttgaagcagatgagcgacttggaaccgaagttcttcgcgccgaccgtcaggtcaaggtcgacgtgatagtgaatcggcgcttcgataacggccttacgttcttcggcttcaatacgagtgagattagaaccgggcatgacttcaattactccttacggtcgtccctggataatccggactacttggtttctacggtttcgacgtcctgggcgatgtcggccacgacgggcacgatcatcggcttgcggtgcagctggcgcgcaacccagctgccgagcgtgcggcgcatggtctgctgcagcttgtaggtgtcacgcgtgccctgcatcatctggtcgttgagctgttcgacgatctggtgacgcaccttgtcgaactcgctttcgtcctcggccacggcgttcaggtagatcttcgggccggtgacgacctcgtggttgtcggtgtcgaccaccacgaacgcggatacgaagccctcggtgccgagaatgcggcgcttttccagctcgtcatcggtcagctcgccgacggaatcgccatcgacgtacacgtaaccgcacggcacggagccgacgaccgcggccttgccgtgatacaggtcgaccacgtcgccgtcttcggccaagaccacgttctgcgggtccacgccggtcttgacggcgatcaggccgttggccaccaggtgacggttctcgccgtggatcggcatggcgcacttgggcttgacgatgttgtacatgtacagcagctcgccctcgttgcagtggccggacacatgcacggcggcgttgtcgcggttgacgaccttggcgccgagctgcacgagcttgttgatcaccttgtagacgccgtgctcattgcctggaatcagggagctggcgaggatcacggtgtcgaactcgttgatgtggatgtcgcggtggttgccgtcggcgatgcggccgagtgcggccatcggttcgccctgggaaccggtgcacatgaagacgagcttgtcgtcctgaatgtcgttggcctgcttcaggtccacgacggtgccttcggggatgtgcaggtagccgaggtcggcggcgatggacatgttgcgcaccatcgaacggccgacgaacacgaccttgcggccgtacttgtgggcggcgtccaccacctgctgcacacggtgcacgtgggaggagaagctggcgacgatgatcttgcgggtggcctgggcgaacgcttggtcaagggccgggccgatggaggtctcgggcttgacgaagccgggcacctcggcgttggtggagtccatcatcagcaggtccacgcccttttcgccgatcttgccgaattcgacgaggtcggtgatgcggtggtcgagcggcagctggtcgagcttgatatcgcccgtgtcgatcagggagccggccggggtcttgacgtagacggccagggcgtccgggatggagtgggtgacgttgacgaattcgaggtcgaaggggcccaccttgagcttctcacggccggcaacctcaaccttggtggggttctggtggtgttccttgcacttggcgtccacgaaggcgagggtcagcttggagccgatcagcgggatgtccggacgcagcttgagcaggtagggcacgccgccgatgtggtcctcgtggccgtgggtgagcaccagggcgtcgaccttgtcgagacggttcttgatgtagctgaaatcgggcaggatgagatccacgcccggctgctcctcctcggggaagagcacgccgcagtcgatgagcagcaggtgaccgttgtattcgatcacgttcatgttgcggccgatttcgcccaagccgccgagcggcgtgatgcgcatggagcccttgcggtacttcggcggggcgatcagcacggcatcctgctggggtgcggtggcctgccgggtggcgttgatcttacgggacggcgtacggctgttggatccgttggcgttgcggccgcgcgcggaaccgcgacggcgagaattcgtgttcttgcttgttttcttttgttcttgtgccataacctttttgggatttctgttgtggtgcctctgctctgtcatgcaggggcggcgggctggcaacccgtatgcagcgtttcgggcttacagcagtccggcagcgcgcatgccctcttcagccttgtcaagctgagtggcgtcgggaccgatgttcggcagacgcatggtggtggaggggataacgcccttgaccttgagcgcagccttggccatgacggcctgatagccgtcgccattcaacgcgtggacaaggggggcgagctggttggcgaggcgacgggcggtagtgatatcgccgcgatcgaatgcctggacaagctgctgcatggggttggaggcgacgtgggcaatcaccgaaatgatgccgacggcaccgatggagaggaacggcaggaacaggccgtcatcgccggaataccaggcgaggccggtgcgctgctgcttctccactgcggctgcaagatcgccggtggcgtccttgacagccttgacgtgttcaagttcggccagtcggtcgtaggttccgaccttgaccttcaagccggtacggccgggaacatcgtagacgatgatcggcttttcggcggattcgtcgacggccttgtagtggccgacgataccgtcctgcgaggggcgggaatagtaaggcatgacgacgagcaccgcgtcggcacccgcttcctgagtctgttcgaccatacgcacggtgtgtgcggtgtcgttggagccggcgccggaaatcaccggaacgtcgacgacctccttgacggccctgaccagctcgaccttctcatccatatgggtgacgggcgattcgccggtggtgccattgaccaccagaccatccgcgccatcggcgacgaggtatttggcgagcttctgcgcggcggcgaaatcgacgctgccgtcggatttcatcggggtgaccatagccggcagaatgcggccgaaaggtgctgaatcaagaaggtgcatgtcatgctcgctcatagtgttcaccgtacttcccattgtggactcttatactacgtaccttgattgttgctgaatgcgtggcattatggccggagccggtggcaatgccgtgatgcgcgtcccggcgcgcttccctgcctgaaatgcgggggcgactactggtcgactgcgggtcgattacaggtcgaggaagcggtcgaggccgatggtcaggccagccggagcgtcgccggcgagcttgcgcacggcaagcaggacgccgggcatgaagctggtgcggtcgaagctgtcggcccgaatggtcagctgctcgccggcattgccgaagagcacttcctcgtgggcgttgaggccgcgcagacgcacggcgtgcacgtggatgccgtcgaccacctggccgcgtgagccgccatcggtttcggtggcgtccggcacgggggcgagtcctgcggccttgcgcgcttcggcgatgccgtgggcggtgtggatggcggtgccggagggggcgtccaccttggtggggtggtgcagttcgatgacttcggcggattcgaagtatttcgcggccttggtggcaaagtagtcggccagtacggcggagatcgcgaagttaggtgcgatgaagaccttctgggtttcgggcttcggaccgttggcgatggcggatttgatctgggcgagtttctcgtcggtccagccggtggtgccgaccaccacgtccacgccttggccgatcagggtcagcacgttgttcaggctgacggacggcacggtgaattcgatgaccacatcggtgttgtcggtggtgatctgggtcaggtcgtcgccggcatccaatgcgagcgccagctgcgtatcctcggcgttgttcaccgcttcgaccacgtgcgagcccatgcggccctttgctccgaccaccgaaaccttgatcatgtcttcttccctgtctacccgtacctgcccggcaatgtacccgggacgttttccaatcggcaatcagcctatcaccgcaggcccctcacgccaataccccgtccacagaatcaagctccctctgacgagccgaaccgtgaagtcgagctccctctgatgagccgaaccgtgaagaaaacgccggaggcgtttttaggtgagggcgaacgacagtgagcaataattcagttggctgaaagccatcattaattgcgttcgagctggacgcgaagcggactgagggagagaccccggcgaagccgccaaccatccatcgggcgtagcccgatcccgtttcacccacgccgcttggccaaggcccatccggccaacgccagtggcacggacgccagcgtgaagatgaatggcagtatcatgcccacatgagggttggaggcgtcaagcacaatgccggccacggacgagccgatcgacgtgccgaccgtgcctgcggtggttacccagctcagtccttcggtcagggattccgccggcaccagatccttgacgatgaggttgccggtggcgaacgtcggcgagacggtcaggccggcgaggatttcgaagacgcccagcaggatgagattgtccattgacaaccggaagaacacgtagccgacggtcagcagcgacaggaacatcaccatatgcgcccaatgggagcctttgagttggcaagagccgaacaccagcgcgccgatgcacgagccgaccgcgaacatcgccaattgcagaccgaggaagggctcaagtcccatggatttcatggtggcggtaatggacacgtcgaaggacgtgaagctcatattgaacacgatgaacacggcgagcaacggcagtacgccggcatagagcaatacactcttgggcttggcaccgctgcgtttgagttggcgcagggtcagctggtcggcatcttcgcttgcagcggggctgccgtcatcgtgcgcggccacgctgacctgttccacgatgaccggcggctgggtggatttcagcgagaagaatatggtgccgccgatgccgcatgccacggtgggcacgaacagttgggataccggatgcacggaggtggccagccaagccgccagaatcggccccagaataaagacgatctcgtcaatggcggcttccatggcgtaggccgtgttgagcagctgttcgccatcttccacaccgcgcaacgcataggaccaacgggttcggaccaatgcgccgaatgagaactgcgtcagacccatgatgatggccaaagcgaacagcagcggaatcggcacgcgcaccaacgccgcgaaggcgaaggcgagcatggccacgatctgcacggcgagcgcaagccggcccacgcgggcttggccgaaacggtcgaaggcgcgggcgtagaacggggtgacgcagctcatggccagcacataggcggcgctcatggtgccggcgatggtccaattgtcgtagagatggttgagcgccagaacgatgccgagactcatcatggagatcggcaatcgtgccaccgcgccggacaggcagaacgccttggctccgggcagcatgaacaggcgctgatagggcgagtgggcagcggacgacttcgaaaccgcgcgagtcgtggacacaataactccttactggtgcgttgtccggcacgtgcgcccgcccacacgtgccatccgaggggtagcggttcccaagcaacgtcacgcggcgcgtttcaaccgcggaccggtacgtggccagtcgtcttcatcgtcggagatgccttgcgatgcataaggtctctccgccggtgaaggccgtccgatgctgtacaggtcatgagcctttgggctcagtcgttgtcagattgttcgggaatgccggagctcaactcggtaaggatttcctgtttggttttcgcgcgggcgtgaagctcgcgcaagccctcgtcgggctcactgacatagtagagagtggcgtcgatactgtccaattccacaccttcgaccgctgccagcagcagtcggtacatgtcgagctgggcgagtttgcgggtgatgtcgtctggcttggtgggccgacgaccggttttccagtcgaccacggtaaagcgtgcggtggtgctggacgggtcaagtccaccgatgaataccgcatcgagtttgccattgaccaggcccacgcccggcacgtccacgacgatggcacgctccgtccacgccgggatgcgcttggcccacgatgattcggccagtctgcgctgccacgccaccagcttggactcggtggcattgtcgctacttatggaagtggcggaggcggcggatacggcggatgcggattgttgagccgtgggctgtgggacagcgggctgccgtgtggatggcttgcggcattgccgctcccgttcggccaaatcggccaacatggcttcccgggaaacgaatcccgcatcctgacctgtatgcggcatacttgattcggcttcatatgccagtaccgcttcatccggcttaccggcattgatgaattgctcagcccacgcatggaactgcgtgccggcctcggccgccggagacgatatgcgcggaatcgggcggataatgctacgccagtagaggcgctcctcccgttcgttcatgccacctacgcgggcttgcaggcttgtcacgttctggcgtcctgcagccagaacgcgttgcgccttggctttgactgcctcatcaagcgactggccgctggcggcatcggccatcaaatcggcgtcgtccaccagcaattgcgcccgttgcagcagtggaccggcgtcttggtgccgctcaagtgacgaggaatctgcggcgataacatcgatgccacgtgacagctgttcatgcactgcgtcgctgagggtagccggccacggcaattcgacagcggcatccgtctgcgtaatcggcgtctgccatgcctcccccaccacggcgtcaccgtatgccgcggcatgctctccgataaagaacccttcgggagtggcaatcgcttcgccttgcgccgagatcagcatgggcttcccggcattggcggcttgcagccgttccacacagtcctgagccgatatcgcatgttcacgggcttggagcgcgtcatgcacttcaagccagaaattggatggctgagcggcgcgagagcctttgggcaccactgacgggtcccgcccggattcgcccgtataggcgcaataggtcatcagggcatcttctcgcgcacgggtaagcgccacatacatcaatcgacgttcgtcggcatgcagccggcgcccatattcctccgcctgcgtcaaataccagccggatgcatccacttcttccacgccatcgccgaattcgcgcatggagccgaacacttcatcatcaataagctccacatcatccaaagccgccaacgatgcgatggggtcggcttccacatcggcatcatgggggaatcgcggcagaatgccggcatcggcacgcataggcacgggtacggcggtggggttggtgagccaggagtcggcggtctcatgatattcgggtgcggtccagtgaccttgctcggtgcctcccgtatggtgctcgtccagcacgatcttgagatggtcgccctgattgctggggaatccgacggcggtaagccccactaccgcaacggcatcccattccaaccctttggactggtgtacggtcatcagttccacatccaccggagcgtcagggagactggcggcttcatcctccaccgaagccagatgatccacccatgtgatgaacccatgcaacgagggagtttgctcagcggcaatctcttgcgtgtacgtatccaccaaatccacaatcgcatccataggcatatgcgccaaagcgggattggcgcggtgctgcggattatgcagcacaccggccaatacggtgtcgatgtcaagatccaacgcttctatgccggcgcgaatcacgtcgcccagtggccgcccgacggcatcatgcacctgacggagcatcaccgcggcccgggttatggcgttgcgcccgtgtgcgctcaaccgttcaagcagttttaccaggtcgccgcgtgacgctctacatctgctttgaggtcttctgggtcgaaaaggaacaggtcttgagcaggaatatgtccgtcaccgtccggtagctgaatgacgataccgtcatcggcggcatatacctgcccgtcgaaaccgtagcgttggcgcagtctgcggctgatggccatggaccacggttcgtgaacgcggcggccgaaggggcttaacagcacgatgcgccatccgccgtcttcatcgcgtgtgcgctccacgataagggtttggtcgctggggactgcaccagtggcggcttgttgctcggagagtaggcgggccaagttggtgatggcgttggcatctaggccatcgtggtggagacgggtgaggattgttgggatgaaggttgggacagctggaccttctgcggcagacctcccctcagtccgcttcacgtctaatccggcggcgatttctcgggtgaagcgggctatggtacggctgaaaccgtagtcacggccagcgccttcaccgtgccagaacggcaggcgggcggtgcggcccggagccggagtcacgaccacacgatcacgggtgatttcctgaatctgccatgtggaggtgccgagcgtaatgacatcgcccacacgcgactcatagaccatctcctcatccaactcgccgacgcgacgctggcctttgccggcgtccgcctcaggcaggaccacggtgtacagccctcgatcgggaatcgtaccgccagaggtaacggccactttctgcgaaccgggacgggcggaaatcaggccattatcccgattccataccagtcgcggccgaaaggccgagaattcctcgctgttgtattcgccggacatcatgccgattaccgcatcgaacatgtcacgtggcagttcggcaaacggcgcagcacggcgcaccgtggcataccagtcatcagcgttcaaatcgtgcatcgcggcagcggccacggtctgctgggcaagaatatcgagcggattgcgcggcacggccaatggttctatatcgccggcaatcatggcttccagacttgcggccccagtgacaatctgctgacgggtgagcgggtagaacaatgcgtgagagacgccaccgacctgatgatcggcacggcctacacgctgcaatccggaggagaccgacaacggcgtatcgacttgaatcaccaagtcgaccgagcccatatcaatgccgagctccaaactggaggtggccaccacgcaacgcaattcaccacgtttaagccgttcctcaatcattttgcgacggtctttggaaaccgacccatgatgagccatggcgatgacatcatcgccctcatgtgagccgacaagcatggtggtggagccgaccacagcatcgtaatgcgtggagaacccttcgcggccttccggagagcccagatcccgcacagtgtcgggattggtgccatgccgggtctgcgcatacagatcgttcaagcgcgcagtgagtttctcagccacaccacgcgaattaacgaacaccaatgtagtgcggtgcgcgagaatctcatccaaaatactgcgttccaccacgggccaaatggaaccggaggtacggtcgcccgccgctccaaccaacgcggaggaatcgaacgcatcactcgcatcagaatcgtccccagaagtggaagaaacatctctatcatccaccggcacaatgcccctgcgttcagcaagtcgctgcatggccggcgtgacaccactgatatgcggagcggaccgttcagcatccacgccaccgacacgctgcttggcattcacggactgcaaatcacgcatgttttccaacggctcaatcatgcgcaaatccattgcaggccgcccaccgggattcacgatggtaaccggttgcccgccgcccaggaatcgcgccgccttttcaggcggattcaccgtagcggatagaccaatgcgctgcatatgacgatcgccacggccagcatcgacggcggcatcaccgccctcatcagcatctgcatcgattgcatctcgcttgcgcgattctgtgacaaggttctccagccgttccagacttaccgccaaatgtgcgccgcgcttggtgcccgccactgcatgaatctcatcgacgatcaccgtatcgacagtgccgagaatccgccctgccttcgaagtgagcaacaaatacaacgattctggcgtggtaacgaggatatccggtggatgggaggctatgcgccgccgctcctgtgcggtggtgtcgcctgaacgagtggcgaccgcgatcttcggcacgggcagcccttgcgcctcgcattgtgcagcaatgccctccaaaggctgttctaggttcttggccacatcggccgcgagcgcctttaacggcgagatatacagcacacgcacaccggcacgccgcgtgcgtggcacggtcatcaatcggtcgatggctgagagaaacgcagccaatgttttgccggaaccggtaggggcgatgaccaagacattgcgaccggaatggattgccggccatgtctgagcctgtgcctcggtcggctgaccgaaggcatgctcgaaccacatcttggtgggttcggaaaacaggctcaggctttcgtacatatgtacgattataggtcagctgaagtaggcgatgacttcttcggcggtaccgtaggcactttgggcgccaagcttggtggccgcataggcggagacgtaggagccgatttgcgcggattgcagcagcgtatgaccggcggccaagccagccagcacggtccccatgaacgagtcgccgcaaccggtggtgtccactgcattgacttgcgcggcggatacgcgatgccaacgtccgttctcgatcaccaccgatcccgacgcaccaagcgtcactatcgcccggtcgaatccgtaatcggtgaatcgttcggcgacctcataccagtcgagtgattccacgtcatcatccggcaggcccagcagttgagccacttcatgctggttgaccagcagaatatccgtggcttccaccagttcgtgaggcagctcgtccataaatggcgagtcgttgagcagcacggtcacgccagcgtcatgcgcggtctgcgcggcggcgataacggtggcaatcgggctctccagacacagtcccaataccgcgcattcggcgatggtcgtgcgatgtgattgcacatagccggcacttgccttggcattggaacccggcgaatagacgatggtgttctcgccctcagcgctcacggtgattaccgtggcgccgctggggccttcgacatgcaggatatcggcggtgtcgacgccggcctcatccagcttgcttaataggaagtccgcgttggagtcctcgcccaccgcgcccagcaactggacattgacaccgagacgagcggcggcagacgcctgattcgcgcccttgccgcccggcagcactttcatggcaccaccattgacggtttcacctggcttgggtagtcgtttagtggttacggtgtaatcggcgttcatcgagccgaccacgattaccgagcccggcgcatccttcagcgctctcaatcgctcccgtacgggctcgggcatctgttcatgttcttcttcacttatcaccatgggctccaagcatagtaggcgacgggcccaaatgcgcatatgatcagccgcgcaacttgcgaagacgctcgtgcatggccaccatcagcaccaagagcaccagcaaataccacgggtagagactgattgtcacatattgcgcgatgatgccgaacagtggcggcatgagcagtgagcccacataggcgcaggccatctgcacgccgacgatggcctgcgatttgtcttcgccgaagtaggccggcgtcgagtggatgacgcacggataaatcggcgcgcacccgaagccgatgaccaccagcccaacgaccacgccaaggtggtgaggcaatggcacgaacatggtgaggatgccggcgaacaccagcacttggccgaggcgaatcatgaccgggtccttgaatcgcatggtcagaaagccggaaagcgcacgacccacggtgatgcctacgtagaataggctggcccagctggcggcggtgatcttgtcgatgccgctgtgcatcaccatatagctggaggcccacagacccgccgtggattcgacggcgcagtagcagaagaacatcacgaggatttccttggcaccacgaatggcgagcacgccggccacgccgagcggtttgcgttcagcaacagacaccccttcagcagtgccaaatctctcggcattgccgtcagatgatgcggtgtcatcggtcgattcgccgaccgcaattgcgccacgtttcttccacagtggcaggctcagcaccaggatgacggtcagcatcacctgcaggatcgcgatgtaccgatagccccacggccaaccttggccttgagagagcgcatagcccatgatgtaggggccgaccgatgcgccgacgccccacatgcagtgcagccagctcatatgccggctttcgtagtgaatggctacgtagttattgagcgccgcatccactccgcccgcgccaaggccgtatggtatggcgatggccaacagcacccagtaattcgaggtaacggagaaaccggccaaggccgccgcagtcaacgccaccgaaacggcggtgaccttgcctgccccgaatttcaatgtcattcggtccgaaagcagcgccgagacgatcgtgaacatggaaatcaccgcggagatgccgccggcccacgccaccggcacgttcagatcctggctcatggtgggccatgcggatccgagtagcgaatccggcaatcccagactgataaacgccacatagatgacggcaagcaacagactggccatgtcccatctcccattcacagtacggcaccggttgtgataacgatgtcatcagtctatcgaatagcgcttcagcaacacgcaaacatcacagtttggagtcttgcccgcagtacaccggcgtggaatcggctacgccgcgcgggtcaaagccgatgatgtcgtagttgtccttgagataatcggcggcggtgcactcgatgaaatcctgatgatataccgcagcaccctctgacgaaatagctgtccgccaaagacggactgaggggagagaaatacgagtagcccgctaccacccgaggcctctcccccagtcagcttcgctgacaccccctcatcagagggagcttgagataggacggtcaggtatcgatcttggagcggtcgaaatcgtcggcgttgtcgacgatgaactgcttgcgcggcggcacgtcgtcgcccatcagcaggctgaagatctcggatgcctgggcggcgtcctccatgcggatgcggcgcagcatacgcgtgcgcggatccatggtggtgtccgccaactggtcggcgtccatctcgcccagacccttgtatcgctggatgtcgtcgttgtatccgatgcgcttcttgtcgaggtcggccagtttgccggccagctcgtcatcggaatacgtgtagatatattcgcccttgtgcgagcctgtcaacgcgatgcggtgcagcggcggcacggcggcatacacgtagccgtgttcgataagcggccgcatgtaccggtagaacagcgtcagcagcaggatacggatatgagcaccgtccacatcagcatcggtcatcatgatgatcttgtgatagcgcgactgttcgatgtcgaagctctggccggagccggcacccaccacttggatgatggccgcgcactccttgttggagagcatctgcgtgatcgacgccttctgcacgttcagaatcttgcctcgaatcggcagcagtgcctggaaaccggcgttgcgggcggccttggcggtaccgagtgcggaatcaccctcgacgatgaacagttcggccacgtcgtcattgcccggctggcagtcggagagtttggccggcatcgaggcggattcgagcgcgttcttgcggcgcgtgacctccttggccttgcgcgactggatgcgtgcgtgcatttcgccgacgatcttctccagcacgcggccggattgttccttgtacccgcgcttggagccggtgatcatctcgccgaattgcttgtcggtgagccgggtgacgatcggcttgacctgcgcggtgccaagcacgtccttggtctggccttggaactgaggttcggccacgcgtgcggtgaccacggccacgagtccggcttggatatcgtcgcgctccaccttcatggcggagtccttcatgttcaccttgagcttgcgggcgttgtcttccaccgccttgcgaatctgcttggtgatggcgttcatgaaaccgtccacgtgagtaccgccgccgggcgtctccacgatgttcacgaagctcatgattgtggtgtcatagccgttgacccatcgcagggcgatatccacgccgcaggtgcgttcgatttcctgggcgtgcagttcaccgcccttgcccacggcctgggtctcctccttataggtgccctcgccttggatgcgccagatgtcggagatcggctcgcctttggacaggaagtcgacgaagtccttgacgccgcctgtgtgcaggaattccacgacgcgcgggtgcgcgggctgttcgccgaacgcgccatcaacgacctggtcgccggccgtcagtgagaagtcctcctcggccgggctctcggcatcgtcggacgagacatccaaggccggtgcctggtcttgcgcaggttcgactgttgcgtcatcagtggcctcgacggtgtcagtcgccgccgtttccggtacgttttcgtcgatgatggtgattttgaggccgggcaccaggaagctggtctgacgcacgcggtcgatgagctgttcgtatgagaactcggcggttttgttgaagatctccggatcataccagtagcgaatacgggtaccagtggttttgggagataccttgccgatgatttccagctcggtgggtcggttcttgcgagtgcgcttgaacggggaatcgggagacggattggccgggtcggcatccgtgtatacgccagggtgaccttggtggaaggtcatgtggtgcgtcttgccgtcacgatccacttcgacgtccagtcgggagctcagggcattgaccacggaggagcccacgccgtgcaggccaccgacggcgttataagacgagttgccgaacttggcaccggcatgcagtttggtcagtacgacctccacgccggacaggccggttttcggttccttgtccaccgggatgcctcggccattgtccgcgacttccacggaaccgtcggtgtgcagggtgaccacaatgtcgttgcagaagccggccaaggcctcgtccacggagttgtcgatgatctcccacaggcagtgcataagaccctgcgagtcggtggtgccgatgtacatgcccggacgcttgcgtaccgcatccaagccctcaagaacagctaggtccttggcgccgtattcttctttgggcatacagtcctatttttctcttcaaatgcttggctcccctcacagaggggagccagatgatcattgatccaggaagtcgcgcagggtctgcgaacgggacgggtggcgcagcttggacatggtcttggactcgatctgacggatgcgttcacgggtcacgccatacacacggccgatgtcgtccagcgtcttcggctggccgtcttccaggccatagcgcatcttgatgacgccggcctcacgcggagacagggtttccagcacctgcttgaactgttcctgcaacagggagaaggccacggcgtcggacggagcgatggcgtcggtatcctcaatgaggtcaccgaactcggaatcgccatcctcgccaagcggggtgtgcagggaaatcggctcgcggccgtacttctgcacttcctgcaccttctcaaccggcatatccagctcgcgggccagctcgtccggcgtaggttcacgccccagatcctgcagcatctggcgctgtacacgggacagcttgttaatcacttcgaccatgtgcacaggcacgcgaatggtgcgggcctgatcggccatggcacgggtgatggcctgacgaatccaccacgtggcgtaggtggagaacttgaagcccttcttccagtcgaacttctcgacggcacgaatcagaccaaggttgccttcctggatcaaatcaaggaagagcatgccgcgacccgtgtagcgcttggcgagcgagaccacaagtcgtaggttggcttccagcagatggtccttagccttcttgccgtcggcggcggcccacttgagttcacgcttgcgcttgaactccatgccttcgctttcggtgtcgagcaggtgctgggcgtacaggccggcctcgatgcgctcggacaggtcgacttcctgctcggcattcagcaggctcacacggccgatctgcttcaggtagtccttgaccgggtcggcggttgcgccggccgcaatcacacgacgcttcggattgcccgaggggatgatgttctcttcctcatcatccgtgtcggagaccacgtaggcacccttttccttgggctgctcgggtgccttggacttggcttcttcctcgtcctcgtcgtcttccacatcatcgtcgtcggcatcgtcctcatcgaggtcttcgtcgtcggcatcgtcttcgtcaacgtcgtcaagatcctcgtcgaggtcgtcaacgtccaaatcgtcgtcgttgacctcggcatcgtcatcaagctcgtcatcgacctgagtgtcctcgtctttgacgagctcatcgtccttggccttcttcgcggttttcttcgcagcggacttgcgcgtagtctttttcgagggctctgcggacttggacttcttggcggaagtcttgcgtgcggtggtcgtagagctggccttcttcttggtctcggtctcctcgctggactcggctgtctgcttggttgccgtcgtttccttcgtggccaaaactgctcctcctgatctctcgccgtgaagtgcatataccacatgggcccacttctggcaagggcaaatcgtcaactatgtgagtaaaccaccctccacggacgattattcccacatcgttgcccgacgtgttgccgatcaccacacgctttccttccgcgcatcgcgcgtaaaacctcggaaatccgccgtttctgttcactcagcccgagcaccatgccggtgccacgcctcgatcggcggctgagaatatcatcgccgccagcgaacaatcctcatcgagcagcaggcatcgcaaggcgaacaccattgctcgcggatcgcccagccaccataaggtgtaggcgattacggccaatggctgtatgcagtacggcaccggtgaggcttcggcgatatcgagcaacataccgatgccggtatggcaacgctccttatccggcatcatgccttcatcctcgaatgcgcaggtcagcagctcgcccattcgtgttctcgtacgcgccagatgcggtcgcgccgcgaattccatgagccatgacttggggcaacggctttcatcaataaccaacgagagaatcagcgcatcacgaatcgataaggtctcgcgcatgcccaccgcaaacgcggccatcgtctctcggcctaggtcggtgttcccggcatcgaggcaagacagccattcgtccaatggttcggccacccagtcggcattagcctgttgcgcgcctcgaagtcggcgatcattgcgaaattcctgtgatctcgtcttcaactcgtcaaagacaaagggctccgtctgctcggcggcgtgccgtttggcgtgtcggttcttacgcggcttgtgtggcgtgttgttgttcatcatgtcctccttgactaatggtgtgcaatctattggtgttgtggtgcgcgccgagccggatagctcatgcgccgagggggtgtgtgcccactatggctgaaaacgccgtatgacgcaggaaaaaacgaccattgtggttctagcttcaaaacccttgatttccaacgttcttgtgttcttcaaaccctgtggataagttattaggcatgtgcacaactgctaacaaccgcgaaatcatcgagccacgcatcattcagttggtgcgggaactgactgccgcccccgccaccgacgaggttgccgacgccctgaaaccggtgatggaacaggttgtggaccaagccgcctcctccagccaaggaggcaaacgactgcgtgcgctgctcgcgttggacgccttcgatgttcttgccggcgacgtgactcctgattggcgtgacgccatgatcgacctggcctgcgccattgaagtgtttcagacggccgcactggtgcatgacgacatcatcgacgaatccgatctgcgccggggcaggccttccgcacatcgtgccttggaacaggccgtacacagcggtgccataggccgtggcttgggcctgatgctcggcgacattctggccactgcctgcattgaaatcacacgccggtccgccagccgtcttcccaacaccgatgccctgaacgaggcgtttcttaccatgcagcgcgaggtggaaatcggccaggtactggacttggccgtcgagatgaccccgctgtctaatcccgaagctctggcgaacgcctcattgaacgtattccgctggaagacagccagttacaccaccatcgctccactgctgcttgcactgctggccgcaggagagagcccggatcaggccaggcattgcgcgttggccgtcggccagccgctcggactggcgttccaactggcggatgacctgttggatgtcgtcggatcaagccgcaataccggaaaaccaattggcggagacatccgagaaggcaagcgcacagtgctgttggctgatgctctgtctgcggcagatacggcggataaggccgatctggttgccatcttcgaagcggattgtcgcaatgacaaccaggtggcccgcaccattgaactgttcacgtcgaccggtgctcttgatcgatcccgcgagcgcatcgctgccctatggggtgagtcccgtaaggcgattgccggtcttgagctgaattccgaagcgcaacgccgtctgaccgaggcttgtgcgcgattcatccccgaatccttgcgatagtccacaatgcgagccgccggaccatgagaccatgaacaccggtgaaaacccgtgaaagctatgcgctgatgctccggccgcgtaaccggggccatgtacactgaacatgtttagtcgtgattaaaggaaccgtacgatacaacatgagtgagaacgagcccgcgcagatgattgagggacgctaccgcatcgtgcgcaatatcgccgagggtggtatggccaccgtgtatgaggccgtcgatgagcgtctggggcgcaccgtggcgattaaggtcatgcacacacaactcgccaaaggcccgcatcgggagcagttcgtcgaacggttccgccgcgaggccaattcggccgcgtccatcgccaacccgcacatcgttcaggtgtatgacaccggcgagttcaatggacttgattttctggtcatggaatatgtgcatggcgtcaatctgcggcatgagatgaacgcccaaggcacattctccgtacgtgagacgctgcgcgtggtcgcggagacgctggatggtctggcttccgcgcatcgcgccggcgtggtccaccgtgacatcaagcccgagaacattttgatcaatgatcgcggccatgtgcagatcaccgatttcggtctggccaaggccgccagccaggccacattgagctccaccggcatgctattgggcaccgccgcttatctggctcccgaaatgatcgagaacaatcaggccaccgcgcaaggcgacctgtactcggtgggcatcatggcatgggagatgatgaccggcaaagtgccgttcgattcggataatccggtgacgcttgtcttcaagcatgttcatgaggacgtgccgtccgtggccacggtctgccagggcattgatccgtccgtggcggcgttcatcgcccatctgaccgcgcgtcaggtggatgcccgccccgccgatggcgcggcagcagctgaggaattgagccagttggccgccaaattgccgctggaggcgtggcaataccgtttgcatgccgaacccatcggaggtgatcataccgatgccaccgctgcagcgctggtaggcaatatcgccgagcaggccccgctgaccggcgtacctgccggtgcagcaacgttcgagccgtccgtaccggcatttttggccgatgatgccgcaagcaataccgccgataccggtggcgccgcagacgtcaatcccccggcgcctccggtcgcccccaccacggcacttgattcgtcgatgttagccgatgcttcggctccccataagacgcagatcatggcacagtccggcagcgagacacaagtgctgcctcaggccggcgatgccttcacccgagcgcttgccctttccgatgagccggacgtcgcttccaatggcaccgggccaaagaagcagcgcagcaaaaaaccgctcatcatcgtactggtgatcgtgctggtactggctgcaatcggcggaaccgccggctggtggtggtttgccggaccgggcagctattggagtgtgcccaagccggatgacgtgacctgcgatgcgaatgcaggcaccgaatgttcgctggccggcgcggattgggccacgtatgaaagcacgttgaaggctctcggcatcccctacaagacgcacaaggaatacagcgacgacgtggcggaaggcaagatcatctcttcttccgtgaacaagaccaaggccgttgtgaacagccacataagcaagcgagccaatcaggagcttacggtggtggtgtccaagggcgtgcggatgaccaccatcccgaaggatattctcgacgcggattcggccaatggcaaagacccgttgaacgcgctcaagaaggccggcttcgataatgtcaagcacgacgagtcgaaggacgagtattcgatggacacgccgcagggtgtggcgttgacgatctcccctgatcccggtaccacggccaagcacaacgatgaggtgacggttactttgagcaagggaccgatgccggtgaccatgcctaacatcgtcggtaagacccaggatgagatgcaagccgcgctcggcgagttgaagctcacggccaatgtcaccgaacagtacgatgacaaggtcgaggccggccaagtcatttccgcgtctcaggaagccggagcccagctgaagtggggcgatagcgtggacgtggtgatttccaagggtccggagatggcgacgataccgtccggccttgtcggcaaacaggaaagcgccgtgaccaagacgcttgagggtctcgggttcgaggtgaaaaccgacaaggtgctcggtggtctgttcggcacggtacgtaccgtgaaaagcggggatacggatctatccaacggcggcaagattcgcctgcgcgatgccaacggcaaccccaccgtcatcaccctcaccatcgtgtgagatttgaatgaggctccctctgtcttcagacgagggagcctcatttgttaattacttttcggcttcttcagcggcctgctgggccttgagctcggccttgaccttctgggcgtattcgttcacgaattcctgaccgctcattttctggattgcggtggaaacacgatcggtcagcgaacgcaaatcatcatgtgtaatttcatcagccggcttcttcgcaacctcaatcggcttgccatacaacaccttggtcttgcccttcttgggaatcgacgtgccaatcggctgcagcttgtccgagccgatgatggcggtcggaacaatcgggcaaccggtctcgagcgcaagtcgtgcggcaccggtgtgtcccttgtacagtcgaccgtctgggctgcgcgtgccttcaatgtggataccgaacaggtgcccatcctcgataatctcgcgtgcgtgcttgagtgcgccaagcgacttgctgccaccggaacgatcaaccgggaacacgcccacggacgtgaaccaccacttcttgaacttgcccttcaatcccttgccctcgaagtattcggctttgcccatgaagtgcaccatgcgcgggcaggtaatcggaatcaaagcatcgtcaatcaccgccagatggttggctgcgataatcgcgccaccctctcgaggcacgttattcagtccgctgacagcagggctcaaacgatgatgagcaatagggccgagacctttgacgaagaaccagtagagcacttggcattcctcccgcagacgaactagccattggccggtcgcctgattagagtgacagttatgactgagaaccagaatagcaatgccgacggagagcggccaacccccacgccgggcaacggacaggattccggtacttcatccaagtcgtcgactcccggtgccgccggacaagccacgaatggtgccgatacaccgcaatcgcatgacgcgaacgatttggatgcggcgtgggccgcgttcgaagccgagcatcaggccgacttgcatgacgtggcttcctccaggcaggccaaaaagttcgagaagcaggccaagaaacgcgagaaggaggcgctgctttccgtagatgacttggatatcggctcgttcaccgatgatgctcgcccgagccgtggcggcaaaaaaggcaagcagtcaggcccccgtgatttcaccggctccagctggctggataccgataatgtgatggacgcctatgatgatggcggcttcactcccccgaaccctgatcttggtccggtcaaagcatctacggtactgctgacggcgttgctcatcatcggtctcgcaggcgaaacggtgatgatattcgttcccggattgaacgcgattcctctcttaggcgcgctgctcaatattctcttcgggctgggcgtcattttgggcttgggtggattggtggccaaaattctcaaccgcaaagaccgccccggtgatcagggcggctattacgacgacggcgcgagggtgtagctcgcgtaggctgtgtggtccttggctcccctctctgaggctgagccgttaagcgaacagcccagcgggctgtttgtaggcgaggtgtgagagatagcgaaccaatgtatcacaggcgtggctcgtccgtaattgcggccgagccaagataggtcacgaattgaagtcgatggactcctgtaactcggcaatcatggccttgatgcgggcgtcgcctccccaccagttgagacggatcgtcacgtcccctttggccggcacaaccggcacatcagcggcaccaaccgaagtgccgcgcgtcgcagtcacgcacaaggccacggccgccataacagtcgccatatagacacataagcccccctcatcagaggaggctgagtacggtgtatcacgccttggacttggcggtttcgatccacttgtcgaacagggcttcggccttgccggaatcgacggtttcctcggccagcttgtaggcttcggcgaaacgctcggccagtgtgccgttgccgaccagattgccgtcggccacgatggctgaggcggcgttgagcagtgcggtggtgcgggacggaatgtccttgccggccaggaagtccttgaatgcgttggcgttgacgtccggaacgccgcccttgagctgttcgacggtaatcttggccaagcccagatccacagtcggatcgaactcggactcggtaaccttgccgtcgcgaatctcccagacggaaaccgggccggtgggggcaagttcgtccatgccctcgtgggaggtgtagaccaagccagactgtccacggctggcgtacacggctgccataatcgggctcaccttgcggttggcgcagccgatggccacgtgtgctaggttggcggggttggtcagcggccccaggatgttgaagacgcacgggatgcccagcgcggcgcgaatcggccccacgaaacgcatggccgggtggaaagtgcgggcgaacgcgaaggtgatgcccacctcgtcgcccacttcgccgacggcttccggcttcagatccagcggcaggccaagggcttcgagcacatcggcggcaccgcacttcgaagatgcagcgcggttgccgtgcttgacgatcttcacgccggctgcggcggcggccacggagcccatggtggacaggttcacggtggcgaagccgtcaccaccggtgcccacgatgtcggtggtcccaccggaaacgttcagcggcacggcgtgggagaccatggccttggcggcaccacgcacctcgtcggcggtcagtcccagctgctgctgcatagcgagcgcggcacccacggcggccggattggcgttaccttgcatcaggtcgtccacgaaccactccgattcctcagcagtaaggtggtctcccccgaccagcttggtgagaatcgacttccatgtgatctcggccatgatgccctccttggcgtttcctacgccgtgtgatgtatgttcgccgctcattgtaatggttcgtcatttcaaggccctgaatcttccatattgcaaaatatggcgctattgctgttttcgtggatgtcggttcgtcgtcgagccgttggtttcgtacgcgcccgagccggcaccggactcaagcacgcgcatgccggagcggatgtcgccgagctgaataacttgggcgatgtccttcggatacatgatctgcgcgccgcgcggcatcgaaagcacataatcggccagtcgcgggcgcatcaccgcatactcccagccgccgatggcgcgcgacgatttccacggcttgttcttgtctttctcggggtagacctgattgacctgtgcctcgcgcttggcatgcacggtgaggattacggtgccttcggtcttgccaatcacatcgtcatgcagaatcaggccatgctcggtctgcgtggagccgccggccacaagctgatcggtgatcttcttgcccttgcggtcggtgaactgcactttctcgcctgcggtgagaggcccgcgcctcggctccataacttgctccttgcgtgctcggtgggtcaatcgctacaagtctaatgcatgtaagctcgctggtgaggtgatgacgatgcgaatgcagatgacaagccagatcgatgccggcggcaatgaccccattttcctgatgttccacggttacggcaacgacgaaagcgagatgatgcggattctcgacgccgtatatgcgccgacgcgagccgatgcggccccggccgcaattgccgccgtacccagctatatctcgttccgcgccacctacgcgaggccctatatgggcggcaattactggtatcccgacggctgcggcgtggacgagcgccaacgcgaatgcgcggcggtcggggatgcggtggcttcactgctggatgcctcggcattcgcccatcgcaggaagatattgatcggtttctcccaaggcggttatctgtcgtatcgtctggtcaaggtgcatccgacgttgttcgatgccgcgatcctgctcagtccttcgttcatgggcgaggaacaggcggcgcttgactcccctacccgattcttcctggcgtatggcgcgcaggaccgcacgattccgctgcccgaccagcaaacggcccatcaggtccttgaacgggccggacatctgacctatcgcgagtattccggcatggcccatgccatctgtgatgaggaaatcgccgatatccgggatttcctacgtaccatatgatgccggaatagcttcaatatggaatatctccgttcaaagaggtacattcgaccttttgcggaatgatatctccgttcaaagaggtaccggtccaagtagaagcggctcaacaatggcggaatggcgttggccgcgcccattcatcgcgcgatggttctgcgatcagctcaattcccctgccggctgatgccgcccttatgaccggtggccttgaatggcgtggcgcgtgccgtcaccttcggccccggcagattcgtactggtattggatcgaccgcggagcccggcagccggctgggactcggggcgtcgaccagtacccgtgatgtcggtatgccgtttgccgtcgtgtgcctgtttcccaccagcaccgtcagcctcgtcaatatcaatgcccttggcacgcaaagcacgcgcccaccgctcatccatcgtgcgcctcacacgtcccattcgggtttccacgtgtactgcatgtcgtaggcgctgggcgaacggcggcaggtggttcaaggtgatcgggccgaatgcggcggcgtcaaaagacatcgtttgctcccttcgatggtgttggccaacaggttccaagggtcaggcacagcgcctttctcaacccgttcgccgtcacgatggctggcagcttgcgttcactggttcccctgcaatgcgcctcattatggcaacacgaaccgacaggtgccggctgcgcctaggatgggaaacgattgctgcacgccgaaaagggaaggcgactgtcatgaggtatttcacgactggtggttggaagaccgccccgcacttaacctgttcgaaagtttggagccgcacgatacggttgagattgagggactcggtggtgcacgcccggaggcactgaatgttggcttggatgcttgggatttgatgccgatgagtgaaacacgggttgtcgagtggttccacaatcacgatgtcggctcgcccgcgaacgggaccagtaaggccgatgattcagttccctcgctcgatatgccgtcgttctgatgtgattcgcggaatgttcgtgtcgttgttctcgtcgtgggtggattgacacagcattgactgccgttgagatgtatgcacgctgaacacgcgcctcaacggcagtggtctcgtcatctctcgctcacaccaacggattgccggctgcctgatacagcgaccaccagtcacggcgttcgagttcgatatcggcaccggccgccatctggcggatgcgctccggtgtcattgagccgagcaacggctggataccggcgggatgacgcagaatccaagcgacggcaatgccgttgggcgtggaaccgtatttgccggcaagacgggtcaattcggcgttcagctcggggaaatgctcgttgccgacgaacggaccgtattccgtgccggattggaatgggcaccatgcctgaatggtcatatgcttcagccgtgaataaggcaggatgccaccggtgcgatcggctgcgggatcgctcgccatattgaattggatttcagcgtcgagcatctgtgtatgcatcaggccgaactgcagttggttgatttccaatttctgacgaaggccgctttgcaatagttcgatctgccacgggcccatattgctgactccgaaatgacgcactttgccacttgattccaacgcatcgaatgcttcggcgacctcgttcaactcaaacagcgtgtcaatacggtgcagcagcacggcgtcgacgtaatccgtctgcaaagcctcaagctcgtgatcgagtgcgtcaatcagatgcttggcgctgaagtcatacccgtttgcgccgccatcgttttcgccgaaactgtagtcgatgccgaacttggtttggatgaagatggtgctgcggtcgagtcctgcgtccttccacgcttggccgaaacgcttcgaactggcgtgcgcggcatgatcatggaatccatagatgtccgccgtgtcgaaatagtcgatgccagaatcatgggccacggccacggtacgtgccgcatcggcggcatccaacgcgtccatgcgcatcacacccagcgccactcgtgacgcaatcatgccggattgtccgatttcctgagtcttcatagtgtctcatttctgttatcgtgaatcggcgaacgggcactgtccgcctcgttgccgggcagcaatctccattgccgcggcttatgtcaccttatcgcttgaagtgcacttgaaggcaactcgcaggcaggcagcgcgcgctgccgggcgcgtcttcgcgccttcatgtcttcgctgtgaccgagacatcgttgtgccgtaatcatgcctatttcttgtatgatgacctctatagcaacagagctagggggattccatgaacactgccgattcagccaaagtcaccgatgccaatgccggcgcaaacaatgccattcatatcccgcacaatcccacgcttgccggattggccacgctgacccgcaacgtggcgtacaagaccggggccgataacctagtgatggatatcatctcaccacaatccaccggcgatgacgatgaccgccgctaccccaccgtggtattcgtgcaaggcagcgcctggaccacgccgcatcgcgactacgagatcccgcagctctcggctttggcccgcgaaggctttgtggtggccacggtgaatcatcgcgatgcctcgagcgatccccatgacatgttccccgcatatctcgaggacgtcaaagcagccatccgctatctcagggcaaacgcgcgccaatggcacgtggaccccgaccgtctcggtatctggggcacgtcgtccggcggcaacacgtcgctgctggtggggttgaccgccgacgatccacggtatgaggacggcaccaatgtcgatgagagcgatgcggtgaagtacgtggtcagctgcttcccgcccaccgacatgcttgaagcagtcgacgcattcgacgatgagaccaatccattccggctgtattatttcggcccgttcgcggccgtggtgggcgcgacccatgagaccggcatcaatgccgaggtccgtcagcgtgcggctgatatgagtccctacctgcaggtgcgggatgaccagcagtatccgccgatgctcctgttgcacggtaccgccgacaccgtggtcccctatcatcaatccgtcaagatgcgcgaccaactggtcgagcacggcgtggacgcgcagctggtgctagtcgacggcgccgaacatgagtacgatttctggagccagcaggtcttcgacgtgatcttcgatttcattcgtgagcggagctgaacggtaagggcacacgggcgcgtccttgttataggttgccaagttctcttttagccaattttgttggagcccctatctgcacgaacatgccatgacagttctaggctgtgttctaggactgtcaatcggcaatgtgtatgaaagcgtgatgtgatgggtcagacggcgattgatggagttgagggacttaatagggccggcgaaatcggcggattcagcggttcgcggtcggtggcgttgccgcctataccattctggccgtgcttacttcgctactgttgcaacggccgatcaccacggaactgttgctcatcgtcatgtggatcacgctggaactatgtgcgctgaccatgttgcacagttccggagctctcagggcaaccgccgccatcgttttggccatcatcctgctgattttgcttatcgccgacatggcctgctacctcgcctactatcatctgccacccatgcccgctttcatcgacggcaccacaccactgattgccgtaacggtgttttctgagattgtcgtgacgatgattgtgtaggtccggggattttgtttgctatttcgtgttattcaattgtgtcccgaatatatatgggcactgccaaatttatgattccaatcttttcctgcggatcggcttaagataattgactctgaaggatttccaatcaccaaaaaacttgttgtccgtttcagtttgttccccattccggaatttctcacaggtcaattcaagggtgcatagaaaatccgcaacttgttcaagccggtagtcgcgtggagaagcgtcacgatagacaatggcatcttttgagagtgcatactcaatcccgcctcgcagggcatcagtaactatctgttggccaccgtcgtaatacaccttgacagtgccataagaatggaaatccgaaagatgcgccaaaagtagattaacaatatcgcgtttgagttgcgcttcaaaacgttggcggttatcgtcaaaatcacttttacgatgcacaaacgtccgatatgtaatcggcagccgccgagtcatgataacgaataaacccagaagcctcttacgctccgataggctcatcccttcgtaagcatcatgcccggtaagcagcggcccagcatggaaagggacatcaggaagtccatagtcagccaacgactggcggtaccgctctaaggcaagactaatgtccttagactggtcatgaaagacaagagtaattaaataatattctgatcgtttaccccactcaccgctctcatcagcgaagatgctcaatacagacggcatcgcatcccccgtccccgttgacaaaaaatgccgggggagccccccggcgacttggagcctttctcgtttccgagtaaagcaatatatttatagcattttcagcccctagtccgcaagccacaaacggctattccgctgacagctgctcatattgtagccacgccatctactgcagcatcatgtcacggtgcttgtgccaacggaacagacgctcacgatggcggttcagcgtgagacgatcccacatctgattcttggcccactcaaccatgccatcatgttcttcatcttcgggattgcccaaggtatcaaggaaccgctcgaacccatacaccccgccgacatcctccgaaggcgcatcccccgccccatcccaaagctgaggatccgcaacgtgcacgctgcggtaggtacgcatcagcttaatatcatggatccaatcgtcaccataatcgtagtaatagcgagcggtacgcgccttgggaaacacgtcgcccagctcggtttccgaagcaatgcgaacttccggcaacggctccaccggcatatattgttcgtatttcgcctcatggtatgaggactcttctccccacaattcttccacttgcacctgcttcccatccgggaatgtggcacagaagcagaacagatgctcgccgtaccacataaagcattcctgcaataccgcatgcaaatcgaagaacgtcaatgatgccggcaccaccctgttcgccacccaatacccccaaaaggactggcgccaacgaatcggaggcggcacccacgccgacgccatcatggaacggattgtgcgcaacaccacctagctggaaaccggcgactacaacatgagggaacacgcacccggcaagtaaccatcaaacaaccaccacgaacagggacggcaccgatggtgcccaatgccacgcacgccggtgccgtcccgcaataaccccggtgctcaaaccttcaaataatcagcacgtctttcacgataccggtcatattgccgcacaaccacaccttcgcaagacgcgcatccaacaggaagcccctgcttcggacgaaatggaccaggacataagcccaataatcgagctcttcttctaacacggcctcaccgatgccgaattatccacgatatggcagcgaagcaagcttccacaatggagtaatactactcatttaatttccacaaaaaataataacccatagctttagttccattaatattttctctatgcttacgtattatatcagtaactgtagccgcccccaatgcacctgatgcgagacttgcaactggggccaactccggaggtatccctagctgagccacactaatgcagatagacccagccatcaataaagcatcactcatataggtatttttagcattctttactgcatgttgaatattattgattccacattgaatctcatctcgataaaaatccctgtaatcattagctgtaactaattttacagatttcatcgccttagtaattgagcttctgtagttatcaaaagcatccccttcttcttttctcaattttagtattttttcagttgagatattcgctagatatggaatggaatgagtaagctgcgacaaaattcgataatgagatatatcttcaaacgagacactgtcactcatgcctttcaaaacagtaagatccgatggcctgtctgtaaggtatgaacattgcgcttcgatattttgctcattatacattgacaaatcatcattaatctcttgaaaaatctgctgcgctaagccaatctctcgcatagactcaaaatcgagagaagcgccaattccatccttattcaaggcagacaaaacaactgaaggaacttcatatctaaaatgaataaacgaactttcttgtatccctaattctggacaaggaagaatcttaagatatacttcttcgccttctttcatgacatacacctgcaacgaatttagaacagattgaatgacaggagaaccaattgattcaaatctattttggaaagtttgctgaatctgattgagatgtacagtacaactaggacaagtagtaactaaatcaggctggaaataaagtaaaccagccctcacaagtggctcatacattttaatgagaatcaatgcatctaaaaatagatttctatctagagatgaattggattctgcctcttttagtaaatcattgagaggaaaaggaacgaagacattatccgcatacatcacagaaaaattacataatcgttgagcattccttagccgacaattaatatctgcacaaggaaatctacctccagaaagtgattgcgaaggagagaaagagaagagagaaggctgcactttcggttctcttatgcttaaatacatatcccaaaataaatcaagtacttcagaatcactctttgaacacagagcttcatatgattcctgcggtcctctccccaaccgatttatatcagaatagagttcttcatatccttcatctacatagcccatctctactatctcctttgatacgtaaccgaaaattccttcacgcgacgaagtttctgctgcctggtcagtggattgagccagtcgttgtcgctgtaacgctggtagatgtccaagccgcggcccaagatgacccgccatccggtgtcggtgactatggaacgatcgtgcccggactcgctgaattcgtaggtcaacgcaatgcctaatgtgccgaacgttgcttgcacttggctgagattatcgatttgccggtcgggatactcctcatcgcatccggtaatcaaatgcacatgcacttcgtctgaacgattagtgtatgtgtacacggtttcaagaaactccgcgaggttgcgcacctgataagtcttacgaatatacgggtccttgagcgtaatctgcgtcgcaccagcgacatacggaccgaacagcttattatatgtggcacctcgctggctttcagcgaattcgacatgtccttccttggccgttgtagcggcacgctcaatgggagacaaagatggcacgcgcgcaagagtagacaaagacgtagccgtagactcagtggcaagtactggcgacgaagactctgtttcattcgcgttatcaactttatgagttacgtcagctgaggcagcagctttgtcatcaacagaaccgatggaatctccagcaggcacgtcagaagtagtgttatcaaccttctcaacaccgagactagcgtcatcagcgagtgcaacaggagcaaccgtacctctctctgcctcgtcacgctcatcatgcccaccgcgccaatacagctccgggtaatcatcctcctccagcacatgcacggcgaccggctccaccgagccagcccgcgtgtagctgaaatccaccgctgccatggtggagtcgatgcggcacagctgatccttgacacgcttgcgcccttcgatggcgcaacgcagcagcggttccatctgttcggccgtggcctgtccggatggatagatcagcttcatcaggccggagaaggtcttacgcacaccatctttatctcgtgtggacagcgacggcgacagcttgaaatacttctcgaacgccgatccgtaatccacgttgcgcaggttgtgcaatatctccgccaggtagtccaccacgaagccatatccgctcgtgaacatctccgtacgaatctgctcgaattcccacccgggcaggtaatagtggatgcggtcaagaaacgccgggtcatggtattgcaccggcagctcctcgaacaggtcggagttcttgagcatgtatggcacgttgtgcgaggtgttgcccacgaacaccatggatgcctcggcctgcgtcacattggcgccgcgcgagaagctcttgttggccatgtagttcttcatgatgtccacaagagccttgtcggccttcttggctttgcctgcgaactcatcgaacgccaccgtatcccagtagcccaccaagccgatctgcttgttcgcattattcacgaagagcttcgccgccgtcacctcgccaccggaaatgagcatcccatgcggcgagaattcggaatagatatgcgacttgccggtgccctttggtccaagctcgatcagattgtagttgcgttccacgaacgggatcatgcgcaccaagtgcaggagtttggcgcggtcgccgaacagatccgggttgaatccgaccgattgcatcagcaggtcgatccactcccccgcggtgaacttcgcgcgcatggccagatagttttcgcggtcatcatgcgacatctgcacgggcatgagccgatgcaaacgccacggcacctcgtcgcggtcgccggaataggcgtataccagcgtgcacatgcaccagatgcccgtgaccagcagcttgggattcttgtccaccgtaatggaatcgacaaccacgcgactgatgccaagattctcgaatgtggcctcgtaacggtcgagtttttcgttaagcgcgacctgtaccttgtcgataacctggtatcggcctttctcgcgaatcttcgattggatgaggttcgcttcctcgcgatgaacgtaattgtccgcaagaatgtcgcgaacgcgcttcacgccggcattgatgctctcctggtcggtggtggtcgcgtatttgctcagcagatattccagcacatacgacggcaccagcgcattgcctttgacttcgctgaccaggtccttgcgcaccgtgtattgcgagaagtcatcggtgatcttgcggtccagattgctcattacgagagccgccacgccgccctcagcaccagcaccagtcaacgacccgctcacctcattggattcatctgccataatcccaccttacgcccaatctcatttcaccaaagacacattcggcaacgacacattcaacttcagaaatcgaatccgtcatcggtgaacaagccgcgcttgagcagatactccgccttcacgtccagctggcgcatctggctggagccgggaatctgctcgctcacacgcaattcgacggttgtgttgttgaattggtcggcatcgccggccagcaggaatgtggcaggcacgtggcggtcagcggaatccttgctggtggagttgaatgcaatgggcacctcattggagatgagcacacccttgccgtccgccgaaacgccccacaagccggccagcacggtccgttcggacaccttgccgcccaccggctcggtctgcaggaagtcgaccgtgatctgaccagtggtgatgcggtcggtcgtctgctggattctgaaactcactttgcgcacgtcttccgaggcggaccgccccttgctgatgtgcacgattggcaccacgatctccggcaaagaagccccgccgtgcacgtatcgcacgcccggccctttgatacgaaggcgatggatggcattgggcacctggatggtcacgccttcgcctgccatatcccgcaagccaacctgcgccgcgctgaatgtcgtaaatgcagacttgccaaccagattggagcctatgacgaagcgtcggctttccttccatatcgcgtcgccggatggccgttcgctgagccattccgcatccgatacatcgtgattctggtagaggaagccatgatcggcagtgacgatcatattggtgatgttcgcgttggataggcgcttcactaccgcttcaagctcattgattgctcgaatgcacgcctcgaaggttccggattcactggcttccttatcgccaatggcgtcgatggtgttgtggtacacgtacagcacgttgcaggatttcaccagattgcggtattcatctcgcttcatgttgagcagatcctccgcctctatggcggagcctccgacttcggcgagaatcgcggcacgagccggcgtaccgctcgcatccttcccatccacaacggcataataatgcttctttgtatccaaggacaggtccgtatgcggcagcaacgccgccatgcctaattgggtatacgagggcagcgtgctgagttgagccgccatggacgcggtccaccggctttgctcattgagcttcctgcagaattcctcggcgacttcgtaacgcagcgcgtcggaaatgatgaccgcgatcttcttatgcgcatccgtcaccgtcttcacattgcgcgcatagaactcggtttgggagggtatacccgcaatcgcccaactgtccatcttgccgacctgccgctgccatgcgacgccaagctcggactggtacctggagtactcccgttccagactgtccgcgatgtccctgtcccgcgatggggaaccgattttccacgccgcgatgaagcgccggtaacagccgtccacttggtggagcgaattggtataagcctcgaatccactttgcggcgaagtgatggactccacgatgggctggcattgccgcagcatggcacgcagcgcgctcgcggacgcgatgatgtcgtaatcattggcgaaccgggtgaaccagaggccgtaccggcgggcggcgatgatgcgctgcacgtcttcatcggtcacgtccgcattgtccaatgcctcatagagcagttccacgatttgctcgtcgacttcactgaatacgtcgtgctgttccagttcggccaggctcatggtggcgatggtgttatccaacgccagatccgggaacacctcactcgccagcctctgtatcaccggagtggttttcgagttattgcgccaggtatcgaagtcacggcggatgttcgcgtaataatcaatgctattctcggcatcgctgaacccgttccaggcgagacggaacagccagatcacgaaatccttcaccgtgggcttgttcagttgattgccggagtcaaatctgtagatgccgcgtgtgcccgcccagtggtagtcggccaatcccatggcctcgattgtctcgatgccgcgagcggagtctttggcgtattgcgtgagcagctcccgccagatggcctgcaagctatgttcgccgactggcaatcccagcagagatgcgatcatcttcgcttggaaggtcttggcatcgtcttccgcacgcaatcgttgctgcaaggcttgaaccaaatcgtcatcatcaaagaacggcttacaccgctgcatgatggcgagccaatcacggcgcgtttcggcggatgtctcacgcgggaacagctcgttgaggatcatcgacagcttgtccgcagtgaaccaaggaccataggcgatttcaaaatccagtagccaattgtcctcattggccggcagcctgccttccacatataccaggaatttggtggttggttctgcaatcatgatctggtatttcagtgcgaacggattgcgttccaaacgaaccagctcaacatcgcgcagcgcttcgttctccgcttccggcccaacgatgctgtccacttcgtcagaaaactctccagcctcgtcatgccagaacaccacgcgcccttcgctatgcggagtgccgtcgaatggcgcgaagcgcgccgccagcaaacgaccaatctgtgtattactgctcattcaccgtcctcttctccgtccacaggttgcccgtcgtccgccgtcaatcgacattgaccgctccctccatacaaaaaaatgccggaggactacccccggctcttggaagtctcgcattgctactgactaatgaatcagcttatagcgtatctatgacctcgcgcgatttttgtgctcctcgctgtactgcataggcaattgagcggttgacaccgattctctgaatcactcccttatccgtcatgtcattcagtatgtctatcgcacgtcttttttgcacacccagctgatccgctatggatgacgatttcattggaccattctgcacaagcatgtccagcactttgcgttgctgttcgtcaagccgggccatcgattcactgcagtgctctcaccgtgcacgttgagcgcactttcagcgcactcaacaccatttgagtgcattttccacgcattttcagtaccctggtcgaagctcctgttgctgccctcgaacaatagttccttgatggtggcggcatccgcctgccgtgtggtatcggcgacccgggcgaacgtgcccctgctcccgccccatcgacttgatgaagtatggccgctacgctccagaaagaatctccgcgacgatcaccgtcttgccgtcaatgtcccgcatggagatatccggaatgatcaacggctcacaactatcgcaatggcattcgagatggcatccataatggtgaacacctaatcgtccggcacacccaccacacgtagcgtctagtcctcgatgccgaacacaatgcgcccgccctcgccattggcaaacgccactgcagtcttcgtgaatttgatgctgcggtcaggcaaggcaaccttgtactcgacgttcttggattcaccattcaggttcattgtcgctcatttctgactcatcttgttcttcatcagaataagcaagccatcttgcttttgcgagaagttcatcatacgtgatgatctcaggcgtcataatactggatctaaataattcaaatgatcgtattttactgggatttcttcctccgctatcagattggaattctttcgtagaaccaatgactagataggcacgaggacgaaatagataaacctcatcggacaacatttcattgccctcttcatcctctcgtctctttacatgcccattaagttcatcctctgtcaattgaacagttgtatgaacttgggcaatgcctccggacaattccttcgaaattgaccatgtaccagaacgatactgattaacttctagcaattgcgtatctgggcgtttgatctcagcaaatacaaaagacttcacaattccgcttgttgtatataatgcatcagttcttttaccaactgaattaaatgatttacctttaacaactgtttcaagtttaccgggattaaatgccgtaaaaagaggagcgccaagccccgcacccaatatccactgattgtgttcaaaaaaatcctgccatactgcttctggttttgccttattcccgttctttcccaaagcagaccgcgctgaatccatataatccgaatcctcaagaagcttttcaaatcgttttacagcttcttttcgggctttcacggcttttacatctttagcatcaggatcattttccactaggttacggatgctatcaggctcctgtcgatacgcctcttctaacgtatcagtttctttcagtagcctttgtaaagctacgctatctacacgacgagacagctcaccttcgggagagattgattcaattaaatgtatagagctaataaattgattaacttgctctccttgtaacgtaagcacatttttcaatttatccgcatgtctcggattgaactcttgaattacgaggtccttgtaatgccccgcttctttagcgatacaaatcttaatttgccttctattacccaaggtcatcactttactcgaccattctttaccagtggtatcaatagttcgatcaatatcaaagcaatcaaatacttgattgatgtttctcgccggggatccaatatctctagaattcgggcgattataagaaaactctcttgatatataagtcagaccgtcaatccggcttctaaaaaagtcaatctcatccatgctggttattccttcaacggattgacgggccaggtccaggattggacggtggtgcgtttcttttcgattgcggggatgatgcggagggctttgcccatgcgcagatagttgactaggacgccgtcatcgaggtcgatggggagtgtctttcgtcaaataaatctgcgtgtcgtcaccagttaatctgaacaccatcgggatccggcacgccgcggttcgcctcgcgccaccggtgcacgtaacgcatcgtggtgtttttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtcccccatttgccggactcgatgttcgtggtgaagatgatgctgcgacgttcatagctgccggcgatgatctggtagaggagacgggccccgtcgatgtcgaagggcacgtagccgaactcgtcgaggatgatcaggtcggcgcgggcgaggtctttgagcagactgtcgagggcgccgtcgcgtttggccttgccgagctggagcacgagctccgcggtctgccggaacctcacgctcctgccccgttcgacggcgagcatgcccagggcggtggccaggtgggtctttccgcgtcccgtcttgccgtagaacacgaggtcctgcgccttggccgcgaaatcgaggccggccggctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtctatcgcggcgagctggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgcgcccccggtggattcgaggatctcgagcatgcccgccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgcctttcggtcctcgtcgaacaggccggtctggctctcgcccttcctgtagtggtccttgtcccccagttcgaggcagcggccgggaaggcgcaggttgaagctgtcgaggctccatacgccgggcaccggcacgaacagcctgcggcgcacggccccgaccctggcctcgaccgcgcccttctcgtgtcccgagtacgggttgcagaacgtgtactcgaacccgtagtgcgcctggaacgcctggaacaggcgggtcaggcggatcctgtcgaaccatttgcgtccgacgccggcggcgttgtcatacacgatgcgttcgggcaccccgcccagccattcgaataggttcctgagggcctggcacgtgcactccgcgttctccccgggcatcagctggctcggcccgatgttcgagtacgggaaatccaacacgaaatgccgcattcgcgtcacgacgccccggtagcgcacgtcgacctggccgaagtccgcctggcattcgcccggatgccacgacaggtccaggaaacccatctcgcgctccgccatgaactcacgcttcaaccgggccacggtccgggtcaccgtcgacaacgacaccccggccccgtactcgtcgcgcaaccgctcatggatgcgggtcgcggtatgccgctgcttgcgccaggtctcccggtcctcggcgagcatgccctcgatcacgggcagccactcgtcgatcaccgaaccacgacgtcgcctcacgggcggcctggccgataggtcgtcgaccctcagatacttgcgcacggtcggctcgctgaccctctcgctgcgcgctatcgaggcgatggactcaccgttcctgcgacgcgaacggatagactgtatttggggcatgctgatcattgcctttccggacctttcccgaatggaactagaagcaccatcaggctaaggcccacgggtggtcggcatgcctttccgcctaaacccgaaaaatcttcgtgactaaaacctcaacttcctattgaacaaaaacatcgtggtcgaatactcgccgtcgtagtccgtctccgccagcagacggtcgtgcccggtcatgtcatcatgtcccatgccgctcatcgtggccacggtcgcagccggacgaaacctgctgtcatgcgattacttgacacgatgttgcgcttgcgggcgcgaacggattgaattggactaacgggttttatgcagggatgccgaggaggacaaccatgaatcaggggagggctcgactggaacgaattcggtgatggagggctttgcgaaatccccggtcaatcgatttgctgactggttgggatggggattcgtcttcctcggagcgggtataggagcgtttctgggtgtcgtcgcgtacgttcaacactggattagctgacggcttcgaatagttctccgaccgcttctcggatttgccgggtggcatgaggttttcgaccgctcacgtagtggcggcgacctcacgctagtcagtaatacacactttaatctagcagaccctacggctaaggctaggaggccgacgatgggaaatcgcgtatggaaaggtgaaccttccgccggtggccgggccggaacgatcatcgctttgggcatcgcggcgttggtagtggcgggagtatggttcggatggactcgatactagggctatagtccggtttcgaatctgtcgcagacgttctcgatctcattttccgaggatgcgcgggcaatcgtcagcaaggacgaggaaagctttcatggggacggataccggtacgtgaaggtcgccgctgacccagaacaagtcgacggcaccattctggacggcagggattactccagtggccaactgccccaggagaacatccgcataatcaaggaagcggatgcgaccctgcgattgaacctgggaacacagctcgatgcgctctacgaccggcctcataaggagataaccaacgagggcggcacgctgatcatcatccatgatgccgattcctcggaatggcatttcttcgaatgcctcgtctgaaagctgagcactcccgaaacatatgcgattgtcctgaagaagagcccagaccaaccaggccccgattatccagataaaaagaaacccccagtgcatcacggctgagtcgaagaccgtccggagaggccctttgggggaattcttgatatatcataatgagccatgagccgacagtcaaattcaacaactgatttcctctcacggactccaaggaaaggaagtccgcgggagaaggcgctgcgcgcgtgcattaccgatgaacggcttgccacctacaattatgaggctcaaagacgttcatgcccagcgctagagctgtacctgtgggatcacgacatggccagcgcctgtatgggcgacatcgccatcctcgaggtcgctctgcgcaaccgcatggaccggcaactctccctcctcgctctggagcagaatggcactgaagactggtatatggcagggctacaattcgatgaccgaacccagtaccagattcgtgaagcgtggaaccatctcaccccgcaccagcgaaaaaatcatacgcatggccatctcatagcgtcattgacattcggattttggcgcaatctcttggaagacggcggaacaatccacacgaagtggccagaccagcgccgtgcagattatgagaacgatttatggcgcaaaggactcgataagacattctccaatgggcgccagtatgcccgtgcagtggaagaacgctggacgagaaagtacgcgctggatatcgtaaaaacagtgcatgccctgcgtaatcgggtcgctcaccatgagccgcttgtcaacggcatacctctgccgggtgagaatcgacggattgcattggagaatgcgacgcaggcgtgcttcgctctggcgatgatcctggaccgagacctacacgcatggttgatggataacagcaagatgaaacttgtgctcgaacacgagctgaagcctaatgaataggtagtgagtatcgttttcgccaatcatctcttcagtgggaatggcaatgagctgcagcgacaccaacagattccttaggatccgacaccggcacgtccggcctggtatgcgggttatggcaatgctcgatcgccaccgcgggcgaacccgtgccccacatgacatggaagtccttggatacggccgagatcatagcgcacttcgttcacaccgaaggggtcgtaggttcgattcctacatcgcccacccgatatcacgctcgtcagtctatgatggcgggcattttctatatctgccgtgccacggttccttatatggcgtccggcctcgggtggcatttggctgtgagcggtttccgattatgagtggcgtccggccgtcgtgcaatcccgctgcgcgcggtgccgtttgggctgtaatacgggtgctttgaaccggccataacttcttcatatgtcccggggcttgtgtcgtgtgccgcggcgcgcttccatagtggatatggcggtgcggaaggggagccgccatacttacttacttacacaaggacgtcttggtccgccagggcaacgcgcatggaaaggggtttgcgatggtgtgcaccacgctgaatttcgcggagaaatacctgctgaaaaccgaagtcaggtccgttgccggtatgtccggcggtacttccgatgctggtactgatttcgatgtcgatctcggtggcgagggcgacctcggaagcgatcatgccaccggtttcaatcgctcgctatcggccgacgattattgggctgcagccggatatgccgatgagtcattgtattgatggacgtgatgacgcggtaagggcgcgtcgataagtgcggctggtgtcgcggctgatgccgcatttggtgctcgttcggtggtcgcggctgatgttccgtacggaccgcctgcaatggttttgcatcggtggtgcgtcaaaatccggaccgtcgccgacgctgttgacgtctggcggcgttggagggacagataatggattgtcaacgccgctgagaacgattggcgacggtggtgggacagcggatgccccaccaccgtcgccaagagtggtacttgtgtcggtggcgtccaagacatggcccggcaccgacatcagatactctgaacgtcggcggattcccgttctgtgtcccagcgccgacgtttgattcctgcttatgcgagctggcgtcggtaaaaaggcagaacttggttcaccggcgatgtctcagcacgtttgcgcgcgtcggatccttctggagcagcaggaaaacgagcgccacaacgagcaggacggcgatggagagcacgccgaacgaggcgttgccggtcagggacgtggtggtggctaccaggaaggtgccgatgattgaggccgttttagggaagaaacaatagtgagaccggggaacccttgaaatcattggggaatcatggtggcgatgcatgcgattaacaccgccacagacctccatacacgctcactttgcgcaactttcccgggaatgcgtcgcatacctttcctatgcaatgcgaaaggccgcccgactagtcggacggcctaaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccatgaggccgtagtacttggtcagacgcttggcccacttcttgtagcccagttcctcattctcgcgaatcgcggaggaggcatacttctcggcgtccagatgcttggcgctcaggatgatgtgtccaagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacatccacaccaatccaagactggtcgaggttagccatgaagtcgagcttctggccgggcttgatcggcgcggggaaagcgatgccaacgggtgcggattcaggcacttcgaagtggtcgagctgctgcttgacgattttagccacggcctgaggagtggagacctcgggagtgagaatcttcaatcgcggctcggcgaaatcgcccttggtcagatcgacgggtgcggccttgatgccggaaccgccaatgtcaacaccgaaagcctgtgcagtttcaatcatcgctgaccttcctttccatacgttttcatcagttcgtaaggttgcgccccagtttaacgcgaattacgctcaacacgaaaccattacacaccaatcatgcaaacgtgtgcatcgtcgccggtcactacgtaccctattcgtatcgtttttcaagcctgacaatgggcaatgcatgcgatttcgcatactaggaaaaatcggcgtctatggcggactgactctgtgtcgcgcgcgataatgagaggtatggcagaacatacccaacttattgatgcaattaacatccgcaccgccgtacgcgcctacgatgatgagccgatcgacgacgatacggcccgccagttcgagatggcgcttcagccgatcaacctactcggcgatctcaacatccagctggtgcgcgaccagcccaaggtgttcgctgaagccaatgcttcaggtcatctgaccaatgcggcgaattatctggctatcgtcggccccgcgaacgatgcggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctttgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcgggagatgagcatcacgcgttcaatgacatgggcatcgccaagctgcacttccagatcggtgccggccaaggccagtgggcttggggcgacggtggcctgttcattcataagtaacctgtagtgacccccctcatagaggggagccactactacggctacttcagcgacggcatgggcttccaggtggggtcgtgcatcagcttgcgcgagtcccaccagcccttggcaatctgcaccaaaccggtcttgaggtgctcgcgatccaccatcaccaggcggatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcgatacccggccggaccaaatgcggcgggcgcaatcgggttcggaatgcccagcggcacaatgaagtcgtactgccagtagaacgggccgccatcgtaatcgaatcgggagccctgaatcacctcgtgcttgtcggtccacttggccagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggtaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggcccgaacgggtcgggcaaatccacgttggcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgcatgagcggcgggcagcagcaacgcgccgccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgagaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggcgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattggcgcaattgcgccggcatgtgggttacgtgatgcagcatccggagcatcagctgttcgctgacacggtagccgaggatgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttacgcacgctcaaatcgcgtggcgtgaccgtgctcatcatcacccatgaccgggaggaggccgagcaaatcgccgaccgcgtagtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctctcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttggaatcagtccgattccaaccgccattactcatattcgcccagcgagcaccgtcactgatccaagatggacccgacgattcccgcaacaatggtcaggaccaaggaccccagtaccgaccaccagaaaccgtgtacgaagacgcccacgccgaacagactgaccgccagccagctggcgagtcgcatgaacagccaattgataatcaaggtgaccagcccgagagacagaatcgcaaacggcagtgcgatcagatgcacaatcggcttgattgacgcattaatcagcgccatgaacaaagcgaacgcggcgatgccgagaatcggaggctcccccaccggggtcatgccgggagtcaccgcgaccatgacggcggcggcgatagtcataatcaaccagctggtcaggaaacttctcatggcccaatcgtagcgcggcaggttttactattgggcaaaacatgagatgatgttgtgcagaaacggtaagaaggtattgccgttcccgattgagaggggactgacccgcatgactgataatcaacaacaaccgtacggttcggacagtgttccgcagccggcacagcccgcacagccggcacaaccgtcttacggccaagatgccgcacagcagccgcagggctatggcgccccacagcccgctgcatacgctcaacccgccgccggaagctacggccagcagcagccgcaatacggccagcccgccggcgcatacgctcagcctcagtacggccagcctcagtacggccagcctcagtacggccagccgcaatacggccagccgcagtatgaccagcccgcagcaggctacggccagcagcccggctatggacaggcttaccagcagccgaacgcctacgcgcagccgcaatacaccgccgctccgtatgccgccgccccggtggggcaatcgtccaagtccaagctggctgccggcctgttgggcatcttcctcggcggacttggtgtgcacaacttctatctcggcaacaccggcaaggccgtggcccagctgctgctgacgcttgtcggctggattctgctcggacttggcccaatcgcagccgccatctggggctttgttgaaggcatcatcattctgtgcagcaagcccggctcaccgtggcataaagacgccaacggctacgaactatcagactgaaactaacctcgggccacgttcattgggcccctgatcaaccacgcctctgcaggtatcatctcgatgccgcagtcgcagcgggatgcgacacgccggccgtgtacatgagttcatgtacacggccgttttctttgttgctttcaccctcaaaacaaacatttatcatgttcacttttgcaagatatgaacatcagacatcacagactaccataacttcccaattgcattaccaatagattaataaccggcaaaacggcttatatccgccatttttcatgctaggctttgaaaccagcacatcaacaaagtgcacaatctttttctacagagaaggtaacatgttgttcaattcatatgtgaatcgaacaatgccagtacttccctaggtgcttgcttggggaacgccatgctgaaaggaacacattatggcggagggaaaagtcatcatcgtcaacccggatatgttcggcaaggacccggattcgaaaacaaccaaggccaatgaagtggccaagagcttcggcctgagcgacgcggcgttggccgaggtcgaggacttcaaggcacaactcaccaaacacaacgcctgggatctgccgttcatgggatacgtcaacgaggatggctacggttacgcctacgtgcccggtgccgccgtggtgtacgacccgtactgggacgcccaccaagcattcctggcgctgcctaaggacgtgcagaccgcattcgccattcgtatgctgttcacgcaccgtccggtcgaccgctatggcgccagcatgttcctgcattaccagcgtggcttcaacgtgaagttcgagggtatcggcgcgaaccagtactgattggtactgactatcaaccatctttttcggattgcccgataaggggcgtataacaacggtgttatacgccccttatctgtattcagtgtcaggcgatggccgcccgccgcccgacacaggcgaatcagtatcgcacgagattcaacagttcctgctgtttggcatagcgggaaacgttggtcagggcgatgcggatgatgtgttcggaagtcttttccaaatgattgccgccggccacatgcggggtgatcaggcaatgcggctcatcccacaacggactttccgccggcaacggctcaggctcggtgacgtccaatccggcaccgtggagccgtccattgtgcaaggcgtcagccaaggcctcgggatcgatggcgtcgccacgcccggcattgatcacgatggctgtggatttcagacgacccagacgatccgcattcagcagatgatgggtctgcggcgagcgcggcaccgccatcgccaccacgtcagccaatggcaacagcgcttccagccgctcgaagccatacatcttttcaatgcccttggccggcacgtccgcatgacggcgcacgccgaaagtacgcatacctacggattgggcaagctgagcgaaatgcgacccgatgtcaccgacgccgataatcagcgcgatgccaccttccgggctcaataccggtccttcatcctgccactgatgatcacgctgattggaggcataccggttgaggttcttcatcaatgcccacatggtggcgaacatgtgttccgacacgctttggccatacgcgccgctcgcattggtgaccatggtgccgcgaggcagcacacccgggcagatgtacgcatccacaccggcgctgaaggtctgcaaccattcaagacgggtgtattgggaagcctgcgagaccggaaagttgccgatgactgcggtagctcgggagcgaagctcctcgggaacagcggccgaccagaccatgtcgccgcggtgcgcttcgtcgcccacgaattcctgcggcacatcgcgagccgccttggcgaaagcccgccgttctccttcgttgagtggcaggcagttgacaatcagcttatgcgtgttctcaatacccatggttcaccaaactaggcggcagggcagatattatcgcggtttcctcatgctgaaccaatgccgaactgctaccggaccaatgccgaatccgccccatcaaaccccaccaaaccaagggacaacccattgcgcatcgaccgtagcgtccgccccgaaccgtacactcacaggtggttttgtgattccatagcgtgcagccaaggcagtacgattgccggtttatccgcacgcacaggtacctacgccggttggtaaaccttacattccataccttgcaaccgaacgtttaggagcatgtatgcctgagcagcatattgataacgagaagattcccacacgtcttatcggcgcgattgtggctgtcggctcacttgccttcattggcattctgaccgaaaccgtgatgaccgtgcttttccccgcactgatgcgcgaattccatgtcgacacggccactgtgcaatggattaccacgatttatctgttggcggtggccgctaccatgcccatcagctcgtttttgaagcgccgattcgcgctgaaaaccatttttcttgcggctgtgattctggccatcgttggctcgctgatcatgatcgtcgcccaagccttcccgctgctgattgtcgcccgcattattcagggcattggctcaggcgtggccacgccgttgatgatcaacatcattctggagcagtctcctcgttcgaaaatcggccgattgatgggcgtaggatcgctggtcattaccgtggctccggccatcggcccgaccgtcggcggcgcggtgaccacagtgctaccgtggcgcgcgattttcgtcatcgccattccgctggtgctaatcgcagcatgcatcggcatgaagtgcattgagcagaagacaccgaccgaggctgcctatcttgacccgattcagcttgggtccattgttgtcgcgttggtcggtctggtgctggcgctcaaccaaggtggcgtggccatcagtgcggcggtgtccggcaagtcagccacacgctccggcattatcgccattgtcagtctgattgcgggcctcgccttgttgatcgtgttcgccatgagttccaagcgtgccttctccccgctgctgcgccttggcattctcaaggatcccgccgtactgttacacgcctgcgcatatctgctgctgccattggtcgccatcggctacggctatgtcatcaccaatgtggcacagctctcgctcggtaccacggcatttgtggccggctctctggtactgcccggagcactggtcggcgctgtctgtgccccgcttggcggctggttctacgataagttcggcgcggtcaagccgattctgattccgatcggcatcgctattttgggcccagtgcttatgctggtgttctcgatgcagcttatgcccttgctgctcgccggattctatttcattttcggtctgttctattccatcggcaatgcgaatgtgatgaccagtggcctgtcggaggtctctcccgagttcaagccggacggcaacgccattttcaacacgtgtcttcagtttggcggcgctgccggtaccgcactgttctccacgattctttccgtggctcaggccggcgcaggagaagaaggcaccgctgagtttgctcacgccactgccgtcggcggcacatggacgtttgccacgatgacggttatctgcctgattggctggtgctgtctggccaccgcgttccgcattcgcgcggcacgtaagcgtgcataaatccgatcatcaatagagtcccagctttccaaacacgtgtggggcgtgccccgggagaaccccggggcacgccccacacgctaatgaaaggaagaaaaggagaaagaaagctttggcgggcagtgccggctgctgtgaccttgccatcacagcagccgggctgatcccgcctattcagttatggtgtgtgtcgtattcggtgcggagaccgagcgggcaagcccgctattttttatctccgccgaccgccatcaccgcgcgctgaagcacaacgaagacgaggatcatgagaccgataacgatggtggtccattcggccggcacaccgaagtcagaggtgagcggatcgaggatggagcggaccagagagccgagcacggagccgagcacgtagccgaagccaccggtgatgatcgtaccgccgatgaccacggaggcaacggcgtcgagctcccagccaacacccacagtgttcttggcagagccgatgtttgcggtgtacacgatcgaggccagggcggcgagagtcgcagaggtcaagtagatgatgtactgcgtgcgcttgaccggcagacccatgagttccgcggaggaacgggagccgccgatggcgtagatggtgcgtccggtgcgggtatggtgcaggaagacgtagccgaagaccacaaccaccagtgcgatgatcacgccgacgttgaaggacagatcgttggagatcttcggattgtcgatgatcttgatcacgttggagatgaacgagaagtcattgccctgcgggaaggtcagcgagtcggtggagatgatggaggcaagaccacgggccaggaacatcgtcgacagggtcgcgatgaacggctgcatgttgaattcctcgatcaaggtgccggccagcaggccgaacacagcgccgatgagcagcatgatgatcatgaccaggaaggcgggcacgccggcgttcgccagcttcaggccgacgactgcggtgatggccacgatagcaccgacagacaaatcgataccaccggtcagaatcggcagggtcatggccacagccagaataatcaggtaggcgtggtcaatgaacagggaggagatgaagcccagtcgaatgtaggtgccgaacaacgcctgacccatgatgatcatcaggatgaagatcaccacggccgcgagggtcgggatcatctgacgatcgagcttgaagcccttcttgggagccttcactttgtttgccgtagctgttgtcatgctgccaccgccttagcttgagccttgagcgcgcgcttgcgtttcatattcgcgctcaggttgtgaatcttcggagcctgcatcacgcagatcacaatcacaacgacggcgaagaaggccggagttgcctcggcgttgacgcccagggtgatgatggtcttgcggatcatggcgataattacagcaccgacagcagagccggcgagggagaacttaccacccagcagtgaagtaccgccgatgacgactgccagaatggcgtacatttcgaggtcctgaccggtcttaaccacgtcgacacgcatcacggatgcggtggcgaacagaccagcgatggccgcgaggaagccggaaatcgcgtagacgaggaagaggatcttcttcggcttgataccggtcatacgggaggcttcctggttgatgcccacggcctcaatcatcatgcccatagcggtcttgcggcacagcaggccaacgagaatcacaatgataacggcgatgacgaagttggcgggaatgcccagaatgaagccgttggcgaaccacttcagcggttcgttgccagcaactgcggaggcgtcggtgttctcaccggaggtgatgaccttggccataccacggccggcgagcatcataatcagggtggtgatgaacggctgtaggcccaggaaggaaaccagagcgccgttgacgcagccaatggccagaccaacagccaaggcgatgaggatggagagccacacgttcatgccattggacagggtctgcatggcggcggcacctgccactgccataacggaaccgaccgaaaggtcgataccggcggtggagataaccaaggtcataccggttgcaatcatcaggtatcgggcagattcctggagcatggtgatcagcgggccggccagaccaccggtgttgctgttccagctcagagccaggaagtcatgctggaagatggtgcagatgatgaccagaagaatgaatgcgacgatcgaccaggtcaggttgctgctcagcagcttcttgacaaagttgttgccctcggcttttgccttttcagccatctcatgcctcctttccggtgtttacgttggtgttagcgatggtttcgacgatggtcgcctgagagacggtgtcgtcgttttcgatttctgcgatcttgtggcggtccttgagaacctcgatgtcgtcggacagacgcacgacctcttcaagctcggaggagatgaagacaacgcccatgccctgagaagccaggtcaagcacgacctgctgaatttcagccttggcaccgatatcgataccacgggtcggctcgtccagaatcagcagctcggggtgcgtggccagccaacggccaatgagcaccttctgctggttgccgccggagagattcttgaccgggcgatccgggtcggcgggacgaacgttgagttccttcatgtacttgtcaacgatggcgtccgcttccttcttgggaatcggcttgaacataccgcgcgttgcctgcagggcgataaggatgttctggcggacggtcaggtcgccgatgatgccctcatcacgacggttttcggtggagtacgcgattttgttcttcaaagccgtgtacggatcggagatgttgaccttcttgccgttgagcgtgtaggtacccgaatccggcttgtcggcaccatacaggagtcgaccaagctcggtacgaccggagcccagcaggccagcgaagccaacgacctcacccttgtagatgtcaacatcaaccgggttgatggtgcccttcttgccgaggcccttgacatcgacgatcggcttctcgccaggggtgatttcacggcgagccttcttggcaccaatctgggacagctcggcggcggacttaccaatcatcatgccgatgagttcgtcgcgcggggtgtccttggtcatgacctccttgatgaactggccgttacgcagaatggtcagacgatcggtaatctcataaatctgatcgaggaagtgggagacgaagaggatggccacgcccgagtcacgcaccttgcgcatgatcgcgaacaggtccctgacctcgttggcatccagcgaagaggtcggctcatcgagaatcagcaccttggcgttgataaccatagcgcgggcgatggcgaccagctgctgcatagcgatggagatggagctcagcggagtgtgcgggtcaatggattcgaggcccatctgtgccaaatacttcttggcggcctcgtgggtcttcttccagtcgatgccgaaggggccgcgcttttcgtggcccagcatcacgttctcaccgacggaaaggttggtgcacaggttcacttcctgatacacggtggcgataccggcgttttgtgcgtcgagggtgccgttgaactgctgaggcttgccgtccaccataatggagccggcgttgatcttgtacacaccggtcagagccttaatcatggtggacttgcctgcaccgttctcacccatcagggcgtgaacttcgcccgggtagagagtcaaatcaacaccatccaaggccttgacgcccgggaattcaatcgtaatgcctttcattacgacgatggggtttttatctgtcatgtctttgccttaaacgagaatgaagtgttatcgttttgtgatatttgagccacacatgagtgatggtgtggaaggaacatccttctcacaccatcacatcaattatttggttcagttatcaatgagtcgcagcagacttatcagtaggcgcgggtgttgttgtccagggcttccttggcggaggcggcgtcgaaggtcttggactcgatctcgatgtccttctcaacggtcttgccatccaggtagtccttgacggcctgagcggtttccttgccgaaaatcgggttgtactcgatcacgtaggagaggtcaccatcaacaagagcctgcagagcgttcttggtaccgtcgatggtgatgatcttgaccttgcccttgaggccggcggcgtcaacagcctgagcggcaccgaggcccatctcgtcgttctgagcgaagatgaactgcgggttgtcggacttgtacttgtcgagcagaccagcggtcacggtcttggcctcatcagtggaccagttagcggactgggactcaagaaccttgacgttggaggcaaccttgttgccccaaccagtgccacgatccttcaccacggacaggccggcagggccttcgaggatgaagccgttggcgccatccgggaagttcttgttcacgaactcggcagcctgctcgccgcaccagacgttggacggtccgatgtgagcaacgatggccttcttggcctcggcgtccttgacgtccacgttacggtcaacggtgaagaccggaatctcagcctcagcggccttcttcagggagtcatcccaaccggaatcctcggtggaggacaggatgatggcgtcgacttcgtcgttaacgaacttgttgaacgcctgaatctgcttctgctgatcgttgttctgggtcggagagtaggtcaggtcaaagccggcatcctcgaatgccttctgaatgtccttctcgttggcggtacggaagccgccctcaggaccgacagccacgaagccaaccgtcttcttgccggagtccgagctgccacctgcgttgctggaaccgcatgcggcaacgctgacaagcgcagcagcagaagcaacgagggcaatggccttcttccaattcttcataaatactcctcctcgagcagtgtttattttttggatgatctttcatcctgtttggtgactgttcgtcatcgacagcctctagtatgacgctcacaggccaaatgttcaatcgcatgcgataacagtttgataacaggtttataacaaattaataacagtggttcaaaaatggcgtcgcaacactgttttgccttgataacagaccaataatagtgattggttgcgcagcggcaatgccgctcgccagccgagcgacaaagccgttgcctcatacaacaagaaaggttattatgaacaccgtttttcttataccatctactgcgcaccgagggcagtgacctggctatcggcgatggtccaggaaccgtcgagtgagccagaaacggagcgaacaatacccaaatcgtccacaatggccaggcgacgggacaggctaatctgccccgatgccatcgacgttatggttccattaggcagacgctgcgcattggccgggcctggtgccatttgacgccatgcctcttgttgttcgctgtttccctcaggaggtgtggtggcgtacaccagattcagatcgttgtagaacgtgagcatggtgacgtgtctgagcacactcacttgggtggccgctttgctcagaccgctcagtgttttatcaccgttgcgcgccacaccggtcatcatcacgccgttcgtgtcctcgccctcgactgccaacgccaatcggcacccttccggagaaaccgccaatgccacaatgctgtcggcagcgccaagccaatcaagcttcagatcggtttccttacccccatctgacacatgcaattcgcgcccgttctcggatacagcccatacttcgccatccagaccttcggtaatcgatcgcatcgactcgccggagaacatcaccccacaggacgcaccatcagattccaggcattcgacgacaccgtccgcacgcaacaccgcaccgccggatgaggaaaaaacgaagccccgagcatcgtcatatccgggggcctcccctacacgcaacggactggagctggccagggaaacgatatgcccaccggtcaacgtgtatacgcccgctgtcggctgctcggtagtaagtttcacatttgcgtcggcatcagaatagtccactccgtcgccggtaatcttcagcgcgtattcggcattgccgtcgcccatagtcagacggatgcgatgtaccagcaggcctcgttcttcctcattcaacgcattgataccgctgttaaggtgtatctccaccacattgttcttcaccggcacgctgtcgaccgcgagtttgatggtaggcaagccggtgcctcgcagcactccttccaaccaggagggtgcatccgagagtacttcaccgactgcctgggtgcgccagttgcgccagctcagccatcgaacatccggtatgagctgtttgccggatgtgctcacctgatacacggatacttggcggaagacttgttcaaaatcggcggtggatatcaccacgccgttctccaacgaggagatgcgccactggccgcttcttttaatcaagatataaggaactttgctgatcgtgctgctatctgtcggcgtatacacgccatgcgagtccagagagccgaccacttggagctgtacttctacaatcagcgagctctccgccccttgcggggtactcatcgtattggcacggcggcggaaatccggcgtaccgctgtagaccagtgccgaggaatcgccattccatccggccgacgccgaaccggtcagaaactcacgggccacacggtagccatcggactgtacgccggcaggcatggcatcatagaaccctttgacgatggtttccggctgcgcatcgtccgcaggtccctgaggattggtgtaaacacgctgagtctgctgttccaccggtgccagagtctgcaccgagccgctaatcggcaaaccgaacggacttgagcatgccgtcatcgtgacgcaacagactatggccgcgcctgcggcggcaatcgttctggtcactcgtctcatagcggcctccccatcatcgtgtcgcggcgaacctcatgataatcatgtgtgacttggctggtggccacaccaaacccaccggtaatacgcaggtcatcgggcgtttcagaagcaaaattcaccggcagttcagcgtccgccacctcaccttggtcggggtcacgcggcagcaataccaagaaccaggtgccctcccccactgccgaacgtacacggatagtaccgtggtgcagcaaggcatcagtcatggcgatggccaagcccaatccggtgccgccggtaacgcgcgaacgtgaagggtcgcttctccagaatcgatcgaatacatgagcgactttgtcttcgtcgataccaacgccatagtcgcgaacgctgatggccacggctttgcggttggccgcgacacgcacttcgatcggccggtcctcagcgaaatcgacggcattggccaacagatttctgacgatgcgaatcactcgacgcgaatcgatacgagtcaaaacctgcacattgggcagatacgtgtgaatcggcacccgtttggcttgggcgatgccggcaacttggtccactgccgtttcaattggttcgcataaatcggtttccacaaggtcaagtgccgcataaccggcatcgtagcgggagatttccaacagatcggcgagcatgtcttggaatcgactgatctggccggccaacagttcgaccgtacgcttggtggaggggtcgaagccgtcttttttcatttcgagcaggtcggaagccatacgcatggtggtcaccggagtgcgcaattcatgactgacgtcggacacaaatcgtttctggaaaacgcttgcttcctccagctcatcaatcttctggttgagcgcatcagccatcgtattgaaggattgctgcagcacaccaagctcatccttacgattcacggtaacgcgcatatcgagattgccggaggccagtgtttccgaggccgctgccactcgttcaatcgggcgcacgatgccacgaatcaccagccagattactacgcccaccacgatggacagcaacgcacagatgaccaccagactgagctgaatctgcgtcaaggactgctgctggaacgtgtacgaataaatggcgaagaattcgaggttgccggccacgccaaagtccaatacggtgccgagcaccgctgcgggcgtcccgctgcccgacatgccggaatcaccgggaatttcgaccggctgatagaacacgctgtcatccaagtcggaggccacggacgaacggatgtcatcagaaatcagactttgatagctgggttcggtggatacggggatgatggcacgcgagttggtatcacgactccacaaatacacacctatcaggttggagggcccctcggattgcaacgaggacgccaagtcattgaccagctgctggatctgcactgtggcggagacatcggccgcgtccagactggtttgggcctgctgcaccatgtttgaatagtcggcacgcgactgcgaagtgatttgggtaagcagcgaggcgcgcactgataccatcgatacgccagagaagacgatggccacggccagtgtaagaatcacggtgagggccacggtgcgggcctgcagcgagcgacgaacttcagcgcgtccgtggcgcagcaagcgtttgaggctgaatcgagggcgcaggttcattgttcaggagtgacgaacttgtagccgatgccacgtacggtctgcacgatttgcgggttctcggggtcgtcctccactttggccctaaggcgttgaacatgcacattgaccaggcgcgtatcgccggaattctcgtatccccagacattcttgagcaggctggaacgactgatggcctcgccggcggcggccgcaagcatgaacagcagctcgaattccatcggagtaagattcaggtccttgccatccttggtggcggtgtgttccaaacggtcgatgacgatggatccgcgttccagatggttgacgtttgcattgccaccgcttgcgccaccggtggcaccgtcttcggcggccggcttggcgatgcggaagcgtgcatggatacgcgccagcaattcggccactttgaagggcttgggcacgtagtcgtcggccccggcttccaagccggccacgacgtcaagtgtgtctgatttggcggtgagcatgataatcggcacattagaggtagctctgatgcggcgggccacccccgtgccgtccagcccggggagcataacgtcaagcagaatcaaatcgggcttgacgatggggaacatttccacagccctcagcccgtccaggcaggtcacggtctggaatccctcgttttccaaaacaagactaagcatttcgccgatggcctgatcgtcgtccacgatgaagatggtcgccatggtgtttgtcttccctttcccactgttattgttgcgttacactttactcccctatgttcatttctgttcgggttccccgccatgcaacatcgggcgaatcttggcaagacgctggctgacttcgtgttcgtaaccgcgatcgttgggatggtagtactcggtgccacgcagctcttcgggcatatattcctgtggcgccacggcaccgggccaatcgtgcgcatacttgtagccctcgtggttgccccactctttcataagcttggtgggggcgttcctcaaatacagcggaacagcgccgatcttgccggcatccacgtccgcgagcgcctggttaatggcgttatagctggcgtttgatttgggcgcggtggccacggcaatcgtagcttcggccaaaataatacgtgcctcgggcatgccgaccagcgccacggcctgcgccgcggccacggtgacctgcaaaatctgcggggcggccatgccgacttcctcgctggcggcgatcatgatgcgacgggcgatgaagcgcggatcttcacccgctttcagcatgcgtgccagataatggatggcggcatccggatcggagccccgcatggatttgatgaatgcggaaatcacgtcgtaatggtcatcgccgtctttgtcgtagcgcacggtggcggtgtccattaccgtagccacgatttcggaggtgatgatgggtcggcgtgcgccctttttgcgggcttcgtcgccggtgaccgcgccagccgcggcctccagaatcgtgagactcttgcgtgcgtcgccaccggccatgcgcacgatatcggcgatggcttcgtccgtggctttgacctcgtccctgagaccgcggtcatcagtcagcgcgcgctgcaccagttcggtgagctgatcaggctccaatgactcaagcttgacgaccaccgaacgggagagcaacggtttgatgatggaaaagctcgggttctcggtggtggcgccgataaaggtcacgtcgcggttttcgacggcgggaagcagcgcatcctgctgggatttggagaagcgatgcacctcgtcgatgaacagtacggtttcccggccgcgtgacacgagccgttcgtgagcgcgggtgagtacgtcgcgcacgtctttgacgccggaggtcacggcggagagttcctcaaacacgcggccggattggccggccacgatggtggcgagcgtggtcttgccgacgcctggagggccgaacaggattacggagctcggcgcggtgagactgcctttgctggccggattggcgaggcggcgcagcggcgagccctggcccaacacctgcgtttggccaatcacctcgtccaaagtgcgtggacgcatgcgcaccgccaacggccgtgtcatcgactccggcgcatcagccgccccaaacaaatcgttctcactcataacgtcctatagtaccccagtgttcgaacagacgttcgagccgcaccttggcttccctcagagaggggagccaggaatcagttactcaccttgtagtcgtggaagactacttcgccggtgtcttgggtggcgtcaaggtccacgatgccttcgatggcccagtcgtggtcgccatcggaatcatcgataatctgacgcaccttccacgtatgctcgtcgttctcgtgcttgtcatccaacatgaacagttcgggcgagcgcgcttcggcgccgatgcccacgtactcgtgctcgtcgtagtagtcgtcgagcacatcttcccattcgtgcacaccgtagccccagtctttgtcgagcgcgccgagcttgtccggctggtcgaggtccataagctgcacacggcggaacatggcgtttctgatcagcacgataaggcctcgtcggtcctcgaccaccgcgttcttcttgcccggcgccgccaaggaggccgccgcctcggactggtcggcggaatcgccggcgttctcccattcatccaccagcgaggagtcgatggagcgcacgagcacgcgcagccaggagatgatgtcttcgagttgctcgtcacgcttttcgggcggcacggtacgcgccagcgtgcggtaggcgtccgagaggtagcgcaacagggtgccttcggagcgggcgatgttgtatcgggtgatgtatccggtgaagtcggaggcggtttccaccatgtcgcgcaccacggatttcggcgatagccagtagtcgttggcccacggcacatcgtggcggtactggtcgaacgcggattcgagcatgtcttccagcggcttcggatacgtaatctcctgcagcttatccatacgctcgtcatagtcgagtccgtcagccttcatatcggccatcgccttgtctcgggcctgacgctcctgggcacgcagcacctgcttggggtcttcgagcgtggcctcggccatggagatcacgtccagcgcataggtgtcggactcggggtccagcagttcgagcgcggccagcaggaacggggagagcggctggtcgagggcgaagtcgtccggcatatcaagggtcatgtagtagtccttgccgccgtccttgcggtcctcggtttcgatgacttcggtatcgaacagggtttggaaaatctcgtcggcccgctggtgcagatgctccttttggtcgggggtctgcgcggaatcgtcgatgagatcgtcgatacgggcacgggcgtcgccgccctgcgccacttcgttgagcaccatcgaatgcgtgattttcaggtgcgggaccagggtttccggttcggcgtcgatgagcttgtcaaacgtgctctggttccaggtcacaaaaccttccggagccttcttgcgcttgaccttcttgagcttcttcgggtctcccccggccttggcgatggccttctggttttcgatttcgtattcgggagcctcggcgatcaccagtccctcggtatcgaatcccatacgaccggctcgtccggcaatctggtggaattcacgggcgcgcaggcggcgcatcttggtgccgtcgaacttggtcagggccgtgagcaccacggagtgaatcggcacattgatgccgacgcccaatgtatcggtgccgcaaatcacgggcagcagaccctgctgggcgagctgctcgaccaggcggcggtagcgtggcagcatgccggcatgatggatgccgacaccggtgcgcagcagtcgctgcagaatcttgccgaaggctgtggtgaatttgacgcctttgatggcttctgcgatggcttggcgctgttccttgctggacacgccggtggaggcgagcgcctgcgcggtctccagcgcggcgtcctgcgagaaatggaccacataaatcggggtttcgccgttgcggaaggcgagttccacggttttttccatcggatcgagcgtgtattcgtagcttaacggcaccggtcgcggcgcgtcggcgattacatccacgtccggggtgtcgttcagatcggagagcttgtcggcaatggcgtccacattgccgagcgtggcgctcatcagcaggaactgggtctgcggcagcgtgagcagtggcacctgccacgcccaaccgcgctccggatcaccgtaataatggaattcgtccatcgccacaaggcccacgtcggcatgggtgccttcgcgcaaagcctgattggcgaggatttcggcggtgcagcagatgatcggcgcgtccgcgttgatgtggctgtcgccggtgatcatgccgacgttgtcgcggccgaacacttcgaccaagtcgaagaatttctccgacaccagcgccttgatcggagcggtgtaataggagcggcggccagtgcacagggcggcgaagtgcatgccaagcgccaccagcgatttgcccgaaccggtcggggtattcaaaatcacatggtcgccggccaagaggtccataatggcctcttcctgatgcggccatggttcgatgcctttgatgtcttccacccagccgaagaatcgttcgtagatgtcatcggccgtaagattccgttcacgctcgtcaccgtcccattcgggggccagccgccccagggatccgtattccttctcgtcagtcataatgctcagtctacccagtggcctattccggcggcacgagccaccctccgtcgctatgcgacgcctcccgccagcgggcggagccgtgcgaagagccgtgccatgcgcttggctccgccagtgggaggatcgctcacgccaaccggcggcgcacctcgtcggggtccacctcgggttcgaggggcggccaggtcatgttcatgttcttcaaggtggtgcgcagcagttcggagaccactgctcgcgaataccagcggttatcggccggtacgaggtaccaaggtgcggcggccgtgctggttttctcgaacacctcctgccatgcggccatatactcatcccagcggtcgcgggcctcgagatcggagatgtcgaatttccagaacttggtgggatcgtccagtctcccgaggaagtgttttttctgttcttcctggcttaccacgaggaagatcttgaggatggcgcatccgctggcggccagttcacgttcgaaatcgttgatctggtcgtagcgggcacgccatacgtcttcgggataggtgccatagacgtgcggcatgaccacatcttcataatgggaacggtcgaatacggcaatccaccccgccttgggcacttcacgcttcacgcgccagaggaagtcgtggtcgagctcctcggccgcaggcttgccgaagccatggtaatggatgcccatcgggtcaccttggctgaacacgtgacgcacgatgccgcccttgccggaggcatccatgccttgcagcacgatgagcagccgccgtgtcgagcctttgacgccattcgcgtacatgagccgctggtatcgggcgatttcggaggagctgatcgaaatgaactcctcggcgtcctctttattgccgtcgaatccgggagtggaatcgccttcgacatcagtgacctgcatgccgtggtggaacataagacgttgagcgggcggcaacgaccatacggcgctgagcagttcactggatttcgccgcacgtgccagtcgttcaggcacgctggcactggagtcgatggtgtctatgcgatccgccgcgagctgtaataccttgtcgatccgtcgatcggttttgtattcctttcccttgccgttcttgttgttctttcctgaggattttccggctgtaccccacttgccggcctcttcaggcttgttggttctgtcgtcgtccttggccatgctcccgattgtacgtcttgtaactcaggagacccagcaacgtagcgacattcacattccacttgttactgcaaatctatagacatgcagtcgttcggaccgtaattgttggctttgcaccaattccaagcctcatccgtcgagtcgaagccctcaccggcaagaatcacatagtatttgtcggaattgctgctgtaggtgggccagtcacccgaccagataagcagtacgtttgacttcttgttgtgcatcgtgatgaattgcgcaagaatatcgtgatagttccaggtcttgccttcagcttccatgcccttgcgcttgctggacagctgcgcggtatacgtggaatagacccgaaaaatcgaacacggcatcggccacgacattatcgtcgctgtcctgcaacgtgagtcgggtggccgaatcattgaatttcgtggatgcgttcttatcatcacaattcgaagtggccagaatcgtgactatcagattgtcgctctcgctcttgatcgaggagactttcatatcggcagcggcatcgcaggttttggcaggctttgccttgtcggggtcgatgtatgccaccagatatccgccggctttgatgacggtgtccgtattcgttacttcgctggtgccgatggtgtagtgcttcttggctttcttgtcactgccgtagatgcccagaccttcacgtcaacgtctgtggagccggtgttcttgagctcgacccaatcgcaacgcttgctatccgggtctccggcagctttcgtattgccggcatagacctcgttgatgattacggatggtttggcagccgtgttctgttcggcagtggtctgctgctcgtccgcagtcgcagcgggcacgccgatcagggcgatgctgctcagtgtcaccgcagcggtgagcagcgcgactgaactttggctgaattactgctgaagctagttcttggatttgcgtcgaaccgtccgtattccgccgacaatcgcgattacagcggtaccgatagctacgctgatcaacgccggtcgttgcgcggcatggagggtggcgagatccggtccggccgcaatggcactgttttcacccgccgagctatccgacgccgggtgattgcccgcgtcggtgtactgggcattgaccacactcgggccggtaagcgccacttggtcggcggtctcgaccttggccacatcgccgtgcttatccaaggtgacgcgggcgcacagggctttggcccagttgatacgctgccagccgtcgctcgattgccatagggggtatccggaatccaaggcagtggctttcaaaatcgcgttgcgctgatcggcgtgcagttcgggataggccagtcgcagcacgtccgccgccccgcgcggtgccatgaaatcagcgccggactgggcggtgtcttgcgggaaggtgtaggtcaggcgtgcggtgtagacgcgcacggccgaggcctggtccgcgaccggctcggtggccaccgggtccagaaaatcgttggtgtagccgcccgaaccggaggccttggtgttggcgatgcaggcggcgagggtagtgccgtggccgtccgcggcgcagcgggacaccagatagtcccgcagctgccgggacgcgggcacgatggacgaagcgaattcgttatgccagtactgcccgttctgggcggatgcgccaatgcgcccgcccatgatgtcaagcggataatgcacgccgagcacgatgcggttgttgccggcctccgaagtgcgggccatgatttgcggcgcgagttcgggaatcatgccggccagcgcgataccccacgaataggcgccggtagtgtggccggaggggtaggaactgtttttctgcaagttcgagtagccgggcacgtgttcgagccatgagggtgattgcttgatgtcaagcgtggcgggcagtccggcgagatcgttagtgccgccgtagctgctttccgcacggttcagataggggcgcggatgcatggccgcacgttttgaggcgtaggtggaggccacgttaaaggagaagatatcggcgacggcgttgagtttcccggatttgagcccttcgctcatatatttgccaagcaccggaccgagcgcgtccggcatggcttcctcggcttgcagatcggagtcgacgagcgcacgcttgcgttgggcgttcaggccatccttatcgagattttcggcggctttgtggttaatggccacggccaaatcttcgtcgagtttcattgtatcggcgtcgagcaccttgccaccgtgttcggcatcggtgggggcctgccaatagttcttttcgtagtcggagagcaatgccacccaatccgggttgggcagctggtcggcctgtgcgattgcaggcgtcacggctagcgtggccgccaacgccagcggcgcaatggtcgcaatagcaaaaacggaggataggtgccggaacatcttcatatgttccaacctatcctccgtgaaggctacgtagccggagcccagtcaaacactcagtaaattcttcgtgccggcttagcggcgattgagctgaccgtcaggcctctgactcgtcttcggacttgcggaacgccgggaattcgccggtttctgggtcaacctgtgactcgggctgggtggcgtcatatccctgttcgtagcgggtgcgccgccagttgcgaatcgaggcgttggtgccacggtgatgcacatggtatttgcgcggcgtaccgcccagcggcagctcttcgagctccttggccaccgcgatctgattgacgttggacgggtctccggcggcgatcggcgccacgggctcggcctcggtgggcgcggccgtgcgctgctgcatgcgcgagggcagccattcggcgagcctcgacaacagccagcaggcgatgaagtaaatcaccgcggccatgaccagcgtctgcaggatgttgaagtacatcgagccgagtcggcgcgattcctgcagcaggtcggtatacatgatgatcgagcctagggcggtgtccttcaacaccacgaccagctgggtgacggcggccggcagcatggcgtagacggcctgcggcacctcgatctccatcagcgactgcgtttcggtcaggcccaaagcgagcgaggcctcacgctggccgcccggcagattgccgacgccggagcgcaccagttcggcgaccaccgaaccgttgtacagcaccaaggccagcaccacggcccaataggacgggctgggcaggcccgcgaacgcgaaccatcgccagaagaagatcatgagcagcagcacgggaaccgcacggcagaactcgacgatcacggcggagacgccacgtaccaacgggttcggcagcagtcggcccacgccgaacaccaagccgaacaccacggcacccaccacggccacgatggtggccttgatggtcatccacagtccgggcaggtagaagtcggtccacgcttcacgttcgatggcgggcttccacagctcccagctgagctggttctcgccgtccggcgggttgtgcaggcgcatgaggataaacacgagcaccaccgcgaacagaatgcccgcgatccagttgacgatgcgaatggtgcgccggcccttgggacctggcgcgtcgaacagcacggaattcgaagtatcggccatatccgtcacctccttacggcgagtttgttggacaggtacgtggtgagcatgccgatggggatgatcaggatcacgtagccgagcgcgaagatcaggaagatttggatgatcacgtcgggacggaattcgatcatctcgctcatcagcgaggatgtttcggtggccacggatgcggcggcggccacggtggagttcttgagcagggcgatcagcgtgttgccgagcggtgccacggagcctcggaaggcctgcggcagaatgatctcggtggcggactgcatgaagcccaagcccagcgctcgtgcggcctcggcctggccaatcggcacggtgttgatgcccgaacgcagagattcgcacacgaacgccgccgtgtacaggctcaggccggtgaccgcgagccagaagaagttcgtggtgaaggtgtcggagaagctgagcttcagctgcgcgtaggcacccagcaccatgaacaccatgatgatggtcagcggcaggttcttgaacagttccacatacgcaccggccacggccctgagcgaggaaatcggcgagatgcgcatcaccacaaggatcacgccgaggatcagggagaacagggcggaccatagggtcagttcgatattgaccagaaacgcgccgagcacgtcatactggctgaagagttccaggaatccgctcatcaggcctcctctccttcgtccggggtgggcgggttgtagcgtacgtcgggcgtgtagttggtgcccttggtgttatcgctgatggcgttctcccacgagccgtcctgaatcatgtccacgatggcgttgttgattttggtggccagctgcgtgtcgcccttcttgatgcccacgccgtagtattcctgcgtgaacggtttgccgaccaccttgagcttgccgcgcgaggcggaggccaggccggccaggatgatgtcgtcggtggttaccgcgtccacgatgccggagaacagggcggtggcgcattcggcgtaaccgggctgttccataagctggacttcggaggcgaacttctccttgacggtggcggcggaggtcgaaccggtgacggagcataggcgcttgccgttcaggtcttcggggccgttgatggagttgtcgtccttgcgcacgagcagatcctgtccggccacgaagtacgggccagcgaaggagacggccttcttgcgctcgtcggtgatggagtaggtggcgaggatcatgtccacgtcgccgttctgaatcatggcctcacgctgcttggagggggcttccttccagatgatctggtcttcggaatagccgagtttcttggcgacgtatttggccacgtccacgtcgaagcccacgtaggtgccggacttcttgaagcccaggccaggctggtcgaatttgatgccgatgcggatcttgccggtttcgtccgcgccgcaggctgccagcgacattgtgcaggccacggcggcgagcgcggcgatcacgcggcaagccttccgtttgaacgtattggtgaatgtcattggattgcgtacccgtctttcagtgggttcgtcagtgggtgaggatcttcgagaggaagtccttggcacggtcggtctgcggatgctcgaagaactcgtcgggcgtgttctcttcgagaatctggccgtccgacatgaagacgatgcggtcggcggccttgcgcgcgaaacccatctcgtgggtcacgcagatcatcgtcatgccttcatgcgcgagttcgaccatcacgtcgagcacttcgttgaccatttccgggtcgagtgcggaagtgggctcgtcgaacagcatgaccttggggcgcatggcgagcgcgcgggcgatggccacacgctgctgctggccaccggagagctgggagggcatcttgctggcctgggagtcgacgcccacgcgggcgagcaggtccatggccagttgctcggcttccttcttgtccatgtgacgcaccttgatgagggccagcgtcacgttttcaagaatggttttgttggcgaacaggttgaacgactggaacaccatgccaacttcggccctgaggttcgcgagctccttgccttcctgtggcaggggcttgccgtcgatgcggatgtcgccggaatcgatggtctcgaggcgattgatggtgcggcacatcgtggacttgcctgagccggacgggcccacgaccaccagcacctcacccttggcgacggtcaggttgatgtccttgagaacgtgcaaagcaccgaagtgcttttcgacgtgggtcagttcgactagcggacggttcgggtcctctttgccgggaaccagcggggtcaatttggccttgctcggtgatgttgtgcttgtcgcgcgcgaacgcactgctgtttcattgttcgtttcagacatgagtgggaggatagcacaccgacgtttccaacgtgttcacagtatgtccacacagttgctcagtcgatgtctcatttccgcatcagacatcgtgaaggcggcattgggcatcggcatacattctcgctgagtcgcgcatcgctcggcgtctgctgtgcgctgattgcctgctgcgtggtggctgagacgttgctgcgacggcaaagcgggcacgtgttgtcctatctgctgattccatgtttggccttggtgtcgttggcgttgctgccgcgtatgccgcagtcgggcgcatggctggcggtcactttgtattgtgtggggctggtctcgccgtttcccatgtcgtattcgtataaatgtgctaggcattttgagcgtggctagctgttcgcacacgatgagtgctgttatacggtggacgacactcccgaagcgcggtggataaccgggcgcggcacacgatatgccggtggataaccggttcgcgccgcttaagttatccccattttccagttttgcccctatgccaccgtggaatgcgctacgctcggcgcatgaacggatacagcgaagtgccgcacaatggcgaaatcaacaactatctgcgcaaagatcttgacgccaaagccacggccaagaacacggcctgttggaatctgctgggcaaagtgcgcacgaaacgcacgttgtgtttctcgctgtataccgcattggaattatgcggcgtggagttgccgaggcacagcacgttgccacagaaggacttttatgtgacggtgaggagcaaagggacccgctcttcattggacaatgtcgactatcgcatatggaatgcaaagttcagcagtatcgctttttcaaacggcgtaacctgcatgcatcccatggatgcgtggatacagtttgcccaatatctcaacctcaccgaattagtggtgctggctgaagcgctcatcagacgttatggatatgccattgaacaattcactcaacgactaacggcctttcaccgcgttattggccgtgcgcgttgtgaggcggcgctgaagctcgtaaaaccatcggattccgttcaggaaactcgtacacgcttggcgcttatgcttttcggcctgcccataccgcaaacacaatacggcattaccgattcagagaacggatacacctataccgttgacatggcttatccacaatacaaagtcgctattgaatatgatggcgatcatcaccgtcgcttccgcaaacaatatgtgcgggaccagcaaaaacgtcgacgtctgcggcaattgggctggaccgtcatcgaggtgttcgccgatgacctgtggaacaccgccaaacaacgtgccttcgcacaagaggttgccaccgcgatgcaaataccgcttcctggccgtcctcaaccttcatgccgggtattaatagacggcagccttaccatcaatgcgcgcaaaggggaatacaggaggcggaaacaagcaaaacacaacaaagcctcacaacattgatcaaatacggagttgcgattgctcctcatggggcggcaattcccccatgaggcggcaatttgctcatggggcggtttgaagaaattgtgaaaccgcggaattaagccattttgacctaccgccccatggggttttcaccgccccatgggttgtttaccgccccacgaggaagttaccgccccatggaaggataaggcagattctagtggtggttgcaacacctgaggtttgagcggcatgacgaacgacggcgagctctcgcagcacgtcatgcaccccaagtacgaggtcgagaagacctacgtcgctacgctggaaggcaagatctccggcaccgtgtgccgtcgactcgtgaccaccggcgtgcagctcgacgacggctggatcaagctcgaccactgcgcgatcatcgactcctcgcgtgaccacacgatggtcaaggtcgtgctgcactccggcaagaaccgcatcgtgcgacgtatcttcggctcaatcggcttcccggtcaagcgcttggtgcgcacccagatcggcccgatcaagctcggtgatttgaagcccggttcctaccgcgtgctgtcccagacggaagtccgttcgctgtccaaggaggttggtctgtgattcgcgttgccatcgacggccccgccggcgtgggcaagtcgtccacgtccaaggcgctggccaagtatttcggatacgcttaccttgacacgggcgcgatgtatcgtgcctgcgcttggtggtgtctgaagcaggacatcgatctggacgccgaaaccgtggatgagcgtgtcatcaccgaagcggtgggcgagttcttcaccggcgaccatttcgatatctccgtggacccggacaacccccgcgtattcgccgacgacgaggacatctccgaggccattcgttcctccgaagtctccagccatgtctccaaggtgtcgaacgtcatcccggtgcgcaacgtgctcatcgccgcccagcgcgcctacatcgcccgcgaagcgtcggccgactccttctccgggggtttgggcatcgtggccgagggccgcgatatcaccaccgtggtgtccccggacgccgaggtgcgcgtgctgctgaccgcccgtgaggaggtccgtcaggcccgtcgcaccggccaagccgtcaagggcgtgggtgctgaggatgtggctgcgcgcgacaaggccgattccaaggtcaccagcttcctgaccgccgccgatggcgttactaccatcgacaattccgatttggacttcgcccacacgctcgatctgctcatcggtctggtcgaggacgccatcgagaaccaggagtacgagcagtatgccgccaatctcgaaggctatgagctggacgaaggcgatgaggatctgatttccggccgcggtttcacggaaggcgcgcgcaaggccggccccaagccggtgggtgtgctggctgttgtaggccgtccgaacgtgggcaaatcatccctggtcaaccgtatcctcggccgccgtgccgccgttgtggaagacacgccgggcgttacgcgagaccgtgtgagctatgacgcggaatgggccggcactgacttcaagctggtggacacgggcggctgggaagccgacgtggaaggcattgaatccgccatcgcctcacaggcacaggttgccgtgaccttggccgatgctgtggtattcgttgtcgatggtcaagtgggcatgaccaccaccgatgagcgcatcgtcaagatgctgcgtgccgccggcaagccggtcgtgctggccgtcaacaagatcgacgaccaggccagcgaatatcttgccgccgaattctggaagctcggcctcggcgaaccatactcgatttccgccatgcacggcagaggagtgggcgacctgctggacgtcgcgctcgacaagctcaagcaggccgagaagacttccggctacctcacgccttccggcctgcgccgcgtggctctggtgggccgcccgaacgtgggcaagtcgtctctgctcaatcagctggcgcgcgaagaacgtgccgtggtcaacgatttggccggcactacgcgcgaccccgtcgacgaaatcgtcaacatcgatggcgaggactggctgttcatcgacacggccggcatcaagcgacgccagcacaagctcacaggcgcggaatattattcctctctgcgcacgcaggccgccatcgagcgctgtgaattggcgctgatcctgtttgatgcttcgcagccggtatccgatcaggatttgaaggtcatgtccacagccgtggatgcgggccgtgcgatcgtgctcgtgttcaataagtgggatgcgatggacgagttcgacaagcagcgtctcgaacgcctgtggaacaccgaattcgaccgtgtgatgtgggccgagcgtgtgaatctgtccgccaagaccggctggcacaccaaccgtctgacgcgagccatggataaggccttggaatcctgggatcagcgtattcctacaggcaagctcaacgccttcctcggcaaaattcaggccgcccacccgcacccgttgcgtggtggcaagcagccgcgaatcctcttcgccacgcaggcatccacgcgcccgccgcgtttcgtgatcttcgccaccggcttcctcgagcacggctaccgccgctacatcgagcgttccctgcgcgaggaattcggcttcgaaggcacgccgattcagatctccgtgaacatccgcgagaagaagaagcggaagtgacacgcgcgtaatttgccagatttcaaatatctggtaaattatctactcggtgcttttgcaccatcgggccgtagcgcagtttggtagcgcacttgactgggggtcaaggggtcgcgggttcaaatcccgccggcccgaccgattagccccggaattctgccacttttgagtggttgtcttccggggtttttccgttttcagacaatatgagacaacatgatgacggacttacctttgtaagccattcgtaatgaattatcaccgacaattcaccgcctccgcacccccgtcgtatgcgtttgccccaaacaggggctagactggttcctattgatttgacgaaagggacccgaattgaccgaaataaacgataaggcccaactggatatcgccgccgctgacgacaccgacgccgtcacctcggacacccccgaagaaaccgtaaacacccccgaagtggatgagactttcgagctttcggccgccaagatgcgcgagcacggcatgagcgaaaccgccatcaaccagttccaccatttgtatgacgtatggcgccatgaagaagcctccagctggattcgtgaggacgacatcgagccgcttggccacgtgcccagcttccacgacgtctatgagaccatcaaccacgacaaggccgtggacgccttcgccaagaccgcattcctcaagctcaatggcggtctgggcacctccatgggattagacaaggccaagtcgctgttgccggtgcgtaggcacaaggccaagcagatgcgcttcatcgacatcatcatcggtcaggtgcttaccgctcgcacccgcctgaacgtcgaactgccgctgacgttcatgaactccttccacacttcggcggacacgatgaaggcgctcaagcatcatcgcaagttcagccagcatgacgtgccgatggaaatcatccagcatcaggaacccaaactcgtggccgccaccggcgaaccggtgagctaccccatgaacccggagctggaatggtgcccgcccggccacggcgacctgttctccaccatctgggagtccggcctgcttgacgtattggaggagcgcggcttcaagtacctgttcatctccaattccgacaatctcggtgcacgcccctcgcgtacgttggcccagcacttcgaaaacacaggtgccccgtttatggctgaagtggccatccgcaccaaggccgatcgcaagggaggccatatcgtgcgagacaaggccactggtcgcctgatcctgcgtgaaatgagccaggtccatccggatgataaggaagcggcccaagacatcgccaagcatccttacttcaacaccaactcgatctggattcgcatcgacgctttgaaagacaagctcgccgaatgcgatggtgtgttgccgttgccggtgattcgtaacaaaaagaccgtgaatcccacggacccgaactccgaacaggtgattcagctggaaaccgccatgggcgccgcaatcggtctgttcaacggttccatctgcgtccaagtggatcgtatgcgcttccttccggtgaaaaccaccaatgatttgttcattatgcgttccgatcgcttccacctgacggacacgtatgagatggaagacggcaattacatcttcccgaacgtcgaacttgatccgcgatactacaagaacatccacgatttcgacgaacggttcccctacgccgtgccatctttggccgcagccaactcggtttccattcagggcgactggacattcggacgtgacgtcatgatgttcgccgacgccaaacttgaagataaaggcgagccaagctatgtgccgaacggcgaatacgttggcccgcaaggcatcgaaccggacgattgggtgtgatttacaacacggtcgaacgataaaaaagatattatttttgtgaaatggcgctcaactgtggaaaaagcctctaagatagagtgagtgtgaggaaactcatacgcacttataacgaaacaataactatacgtgaggactaatggcagagggcacaagcggacgtcggcgtttttccgacaaatggggcaagcacgagctggacgtactggctgtgttgtcatccgcgttcccgcaatggctcacatcccgccaaattgcgcagcgcgtcaaggcttacgccgactcgtatggagagctggcagatcaggccgccaaggccgcgttcgccaagcagttccagcgtgatcgcgccaagctcgctgcgatgggcatcgccatcgaatcacggcagcctgagtactcgtccaagtcggaaggccaggacttcgcgtcctatcgtctgcagttgggcgacgaaccgcgcatccgcctgatgttcgagccggaagatatgccggtgcttgccgccgccaactatctggctcgttcgatgtcgatttcctccgagccggatcagtcccagctcacccaacatgcgtcgcgcaccacgccgcgtgtgccgcagaccccgattcccgggcttggcttggattcgattgcgcctggcttggggacgcagcccattccggattcactggtcaaggttatcgattcgcgtcgtttcgccgccaccgttgacgtggacggcgaacacctgaacgtggcatacaccgattccgacgatttggccatgtttgtgcttgagcatccgggggccacgattgtcagcccgcaagaggctgtggacgcttatcatcgccgtttgcacgccgccagccggttcactctggctgacgaatccgccagccctgtaagcgcctcggtggtttccccgtcgattagtcgcgatgttcgtgagccgggtgatcccgagtcgatcaaggcccagaacaagaagaacggccccgctttccaaacgggcagcgaggtggatcgtcgcctgcgtctgatgctgttcctctccgctcacctgggtgaggaattctcgatgagcgagctggccgagcgctttatcggcaaaccgaagaacgacgacgagctcaagaaattcgtcaacatcattcataaggacatcaacaccctgaccaccgtttccgacgatggtgagatggctggcagccagttcttcgatatcgactggccgctgctggatgccgagggtattgtttccgccaccaactcgttgggccttgaacgtcttgccggcatttcgccgcaatacctcagcatgctcaccgcctcggtcagctacttggcgcattcgccgttactgccggacaagcagcgtgggcaggccgaatccctgtatgagcgtttgcgccgccatgtcagcccgggccagaccccgtggctgagcctgaccggctatgagctggagccccgaagcttctccatcgtcaagcgcgcgatcaacaccgattcgctgttggacatggagtactccgacggtaccggtagtacccgtcgcaagctggtggcccccgccaagattttcatcgacgaaggcgtgtattatgccgccgtctacacggatgtcggttccgccgcccccaaggacaagaaggcctacgtctccaaagacaagaccatcgacaaggcgaacggcaagccgcgcatctggcaggtgctgcgcttggcccgtatcgaaaaggcggaactggtcaagcccaccaagcagatcaacatcccgaacatgccggtgagcgaactgcgcaagtggagtttcgacaacggtaccgacgcggtgttcatcaccgatcagcgcgatctggcattcatcaagacattgccgggcgctaccgtcgaacaatgcggtgccggtgaaaaggtgcatctgaccgtttcctccgactcctggttcgtggccttctgcatcgcacacgcgcgtcatatcacggcggtcgccccggaaacgttgcgcaccatgatcgtggcacgcgccgaacgcgaactgagcatcagcgagaacaagtaaggagcctttcatgccttggtggatatggctgattctggccctgttcatgctggccatgattgttgccggactcatctatgcagcccttcatggaatccgtgccttgaaagacatgtccgacatcggcggccagctcggtgaacgcgtggccgcgatgggggagtctggcacctctgccgacaccagcgagccgcctctgttcactcagccgctcagcgtggcacagaatcgttatgccgaggcccatgcggacgtgattcgcagcaaggccgccaagcgcgaacgccacacccaggcatgggcccgctggaagcgattcaacaactaacggaaagcagcaatggcacgtcaccaacaccataagggcaatgccgattcccagacgctgagcccttcgcagcggtacgcatcattccaaaaagtccagcgccatcgggcgtccgcagcagcgcgattcgccgaatccctgcccttcgaactggacgacttccagaccgaagccaatgacgcgctcgaagccggcagcaacgtactggtcgcggccccaaccggtgccggcaaaaccgtagtggcggattttgccatttatctcgcccaggaacgcaacgtcaaagccttctataccacaccgatcaaagcgctgagcaatcagaaataccatgatctggtcgacgtgtacggcccggacaaggtaggcctgctcaccggcgacacctcgatcaactccgaggcggacatcgtggtcatgaccaccgaagtgctgcgcaacatgctctacgagcgttccaccacgctgaacgcactgcgctacgtgattctcgacgaagtgcactatctggccgaccggttccgcgggcccgtgtgggaggaagtcatcatccacctgcccaagacggtcaagatcgtcggcctgtccgctaccgtgtccaacgtggaggatttctccaactggattgcctcggtgcgaggcgacaccaaactggtgatcagcgaacaccgccccgtgcctttggaacagcacgtcatcgtgcaggcggacgaacacaccgagcctgaggtgctggatctctatcgccgcgacggcaacggcgagcagaccaccaagctcaacgccgaactcatcaaccggctcgaccagttggaccgcaaggccgcacgccggcgcggcgaggaacgccccgataagcgcaagggcttcggcagaggccgcggcggcaaaggcgccaagggccatgccccgaaagcggaacgccacaccccgcgccgctgggccgtggtggacgagcttaactttctgggaatgttgcccggcatctacttcatcttctcgcgcaacggttgtgaccaggccgtggaacagtgtatcaacgctggactggagctcaccaccgatgaggaagtgaccaagattcgccgcatcgtggatgagatggtggaggggcaactcactcaggaagacctgaaagccctgcagttctccaagttccgctttgcgttggaagaaggcttcgcttcgcatcatgccggcatgattgccctgttccgccagatagtcgaacgattgttcgaagaaggtctggtcaaaatggtgttcgccacggaaacactggccttgggcatcaatatgccggcccgctgcgtggtggtagagaaactcgagaagttcgacggtaccggtcatgtgggcctgacgcccggcgaattcacgcagctcaccggtcgtgccggtcggcgcggcatcgacaccatcggccacgccatcgtggttgaccatcacggttttgtgcccgccacggccgccgcgctgtcatccaagcgtgtctacccgctgcactcgagcttccgacccacgttcaacatggccgtgaacctgctcaactccagcgactacgagaccgcgcacgttaccctggaccagtcgtttgcccagtgggaggccaacgaatcggcctggcagctggaatcgcagatcaacacactgaagaacgcgctggccggatacgaacaggcgttcgcatgcgaacacggcgacttcaaacagttcatgaccctgcgtatggagctgagcgacatcgaaaaggaaggccgccgcaaactgaagcacgaagtgttcctgaccgatcaggagcgttcacgcgccttccagaaccttgaccagcgcattcgcgatttgcgcaaggcggagcacgagcatccatgccgcaactgcccggacctccagcaacacctcaagtggggccaccgctgggcccgcgagacccgcgaactgcagcgcgtcaccgatcgctacgactcccgtaccgggtccgtggcccgtcagttcgatcgcatctgcgatattctcaccgggcttggttacctcgaacgtcatgtcaatgcggccggccacattgacatgacgttgaccgaaaaaggctcgctgctgcgccgcatctacagtgaacatgacctggaactgtgcgaggcgctgctcgccggcacgttcgacaagctcgacgccaacggactggccgctgtgctctcttcactggtatacgaggccagacgcgggggagacggcgaaccgaggcactacccgggcggcatctccgggtccatcgcaatcgcttcgtccaagctcaagggcatctgtgaagacatcgatatcctgtgcgaggatcacggtctggacgagatgcagcggccggatttcggcattctcgacatcatgtatgaatgggcggatggcggttcgctgggatcgtgcctgtacggcaccgacatgaccggcggcgacttcgtgcgcactgccaaacgactggctgacgtgctgcagcagattgctgtcgcccagccgctgccgttcgacgggggagagcggctggcaggcctcgcccacgaagcggccgaccgggtcaatcgtggcgtggtggcctactccggcgtggactgacggggctgtttgacgggagtttgtcagccgacgtcggaagcttggaatagcggccaagtccgaactgttgcgtaaattagtagggttaaagatctttcaaggaggatgccgatatggcagaacgtagcctcaggggcatgagcatcggagcgaaatcgctggagtccgacgacaacgtcgatttcgccgcgcgaaacgatgtggcgtatgtatgcccgaagggccaccgcaccatcctgccgtttgccgagggtgccgaaatcccggacgagtgggagtgccgttgtggttccgtggcccaccgtgagggcgacgccgaccgtgagggcgacgaaatcagcaaacccacccgcacccactgggacatgctgctggaacgccgtagcgaagaggaactggccaccctactcgaaaagcgcctgcaaatgcaccgtgacggttggattcctgactacgagtgatctcctactgaacaacacgtgaacttgatgcccagtcatcccgactgggcataatcattgttggaacaagtcgcatatcgtttgacgaccattcaaagcagtcgacatgaacaaaggggagtggaatctcaatggcacagcatccgatgaaagtggtcctattggacctcgacggcacgcttaccaagtccgacggcggcatcatcgcctccgtcgtcaagacgttcgaggaattgggtcgcccggttcccgacgatgccgagctgcatcgtttcattggtccggccatcatcgaatcgctgcgacgcaaccatgtgccggaggatgagcttgaccgggcggtcaccatctaccgcagctactatgcggatcgcgccgtgttcgatgatccgaacgagcccggcaacaaagttcccggccgcttggtgaacgtcgtgtttcccggtatccgcgaacagctgctcaagctgcgtgccgacggctattatctggcgttggccagctgcaagcccgagtaccaatgcgttccgatctgtgagcatttccatctgaccgagctgttggacggcatctatggcgcatccagggataactctcgtttggacaaggatcaggtgattcggtactgcttcgacaaaatcggttttgatgctgcagcgggggacaaggccgtgatgatcggcgaccgctacaccgacatcgacggcgcccacgcctgcaatctggacgccattggctgccgctggggctacgctccggccggtgagatggaagaacacggtgcctacgaaatcatcgagaagcccgagcagatcgaagaagccgtaaaccgttatttccaaacacactgaaacacaacggcgaggacttcttcatgatgggatgcgatggagcctgcgccgcgggcttcgacctggttttcatcggtttgccattgctgtcgctgtatgagattcccatgctgatatggttcatttggcgagcattccactggaaacgagatgacaaggattggctgaaaggcacggcgattcttgcaattgcggtggtcgctccggtgctcctttggctgtcggccttggtatgcgtggactagttgatacaggcgaccgaatccttgtcaaggataactaatctgacataacgtacattatcggttatttaatatcatccttattccggtgagaagcaacgcccaaacgcttgtccatttcggcttctgaggcgttgcgtgcctgcagatacatggcgatgagttccagcagcaccaacacaaatatgatgattgctccgggcaattgcgcgtggtcgtagaacgcgagcatgcgagcatccatcagatctgcggtgaacgtcaatacgggaaacggaatcagcgccgccgcaaacgacatgaaatgcgttttcaccatcgaccagtcgaccggatcgaccggcggtcgccggcgtttcggcgtgaacagatggcctcggctgaccgttatagtgatgatggacacagcaaagatgacggcgaccatccacagaacgcccggcaacaatccgacaacaagcccgttcacccggtcctccaatcagtcataataatcaccgcaacatataaaaacataagatggcaggcaacaaaagcaacacatacaacaaagcgacctgccgaccaaagccagcaagtcgccaacaaccatacatgtatcaggcggttgcgcgttgcaagcgctgtgcctcgagcttcttgcgcatcctcatggcagtcagttcatcaatcggacggcccgtggcaatcgtcagcggcttggtctcaagatcaatatattcttcctgttccaaggccgtctcaatctggtgccacaacgaacccaccgacacggcgaacactgccttaccgctttgcaacagttcgagcatctgttcgctggtagtgcattcgtgcacgttttgaccatcgcacatgatggtcacattggccagctgatcggtgctgcgttgagtcaagaatccgatggccgccgtcacgttctgcagattcacaccggcatcaagcagcttcttggatacagcgagaatcaccacatccttaaacgagtacagtcggcgtgaaccggagccatgagacggcgtgatggacggctcaacaatctgcttgcgtgcccaataatcgagctgtcggtacgtgatgccggccaccttggaggccacagtgccacggtagccgcgcttgatctcctcagtatcgacattggagaacaactccccctgaatcgcgtcagcgttcagattctgacggtcctcaagcgaaacatgaagatgcagccctgtctgtcccatggcactcccctaactcatgcgtgtctcacatgtgactcacactggtgtaatcacatgattgcaatttctgcaatcagtctaaccccgtgctgggtgtggactattgggaaataatggcggatttcgtgaagaacacgagacggaatttaccgatcatgatttcgtcgccgttcttcagcgacgcctgatcaacacgctgacggttcacgtaggtgccgttcagacttcctgcgtcaaccacaaagaactgaccgttgaccctgcggaacacggcatgctgacgggatacggtggagtcgtcgagcagaatatcagctcgcggatcacgaccgacggtgatttcatcctcgtcaagcaagtaacgagaacctgagaccgctcccctggcggaaatcagcaatgccgttccctcggacaatctggtgatggtgtccagatcctcttgagtcagcggtcgatcgccggtggtggtaatgggcagtacattaatcgcgggcaggccgataatggtggtttcgcctgcgctaggaatcgggttggtcataatcccctattctaccgtctttgcatactggttttgcgtagcttcgcgtacttcgtcgataatgatgctgtcagaaggctgcacgttgacgttggatccgtatttcacctggagctgagcgcccacaccgccggcaatatcgactgcgttggacagctcctgcggattgccgatggccttcaccgtgtatgtgggcttgatggtggtgccatccacgatcaagccttcctcggcgtcctgaatgtaggtggaggtgatgacgcgcacgttattgatggcgattacctcggcgccggcattgcggagttcctcgatgaggttgaacatgattgaggcgtccactttagtcgtcgagcctcgtccgatccggatggtcacgccttggcccttcgccgggagtctgccagagatcaagccgctggtctcttcgttttgcttggcgatcttacgcgcctgctcctgctcgttagccgccgatttcagtgagttgagctggctgttcaactgggttttacgctgctcgagattcgagatttgcgtattcgactcgttcagcagccttaccagttcgctctcgtccatcgtttcgtacgtggatttagtgttattgatctggctcatgtaggcgaaacccagcagcgcgcacatcagagcaatgagaatcgaggatagtagccgtgatttgttgctggcccggttgagatccttccggggcttcttgcgcaccgtggggaacgacccggtttccatccggtcgttgaccttgtcttgtgcatgctggtcgcgcattttctccagcatgttgtctgattgtgctttacgtgccatacgtcagtacccttgtcagcctcggaagatgaagcgtctgatcgcggacacgttggagaagatgcggatgccgagtacgacgatgacggctgtctgcagctgcgaaccgacgccgagctggttgccgaggaacacgagcagtgttgccgtcaccacgttggcgaggaaggagatcacaaacacgcggtcggagaagctgcgctcgaaataggctcgcgcggcacccagcagggcgtcaagagcagcgaccaccataatcggcagataaggctgcacgatgatcggaatgtccggcttgacgaacacgccgatgacgacgccgatgattagtcccagaacggctgccattattcattcctttccgcgtacttcacttcgccagtgactgctgcctcaagtgtaatcgaattggatttgctcacctgcgggtagataccggcttccttgaaggaatcgtaaagacttgcaagtttcttcttccccatcgcttcggccaaggcgctcttatcgcctatggcttcaatggtataggggctttgtatcgcggtcatgccgatgagaatatgcccgccggccttgcgtatcgaggtttgcgcgccgagcctattaccgttgatggcaatggcttcggctccgttttggaacatcagggagaccagttgctgcagatccagatcggtgatgactcggatgttcgtggaggtgccgactctcgtcgaggaggattgatccgactggcttgccgcgattggatcggccagcgtcatggtgattccttcgccttcgaccaccgtggcaccattgaccatttcgtcttggataagcgtatcgcttttcacgctgccggatattttcttggactgttcgtcaacttgggagcgcaaattattgacgtccgtggtgagttcgtctatttgcgagttgcgattctccaattgcgtggccaaagtctgccgtacctgcttacgcggatcggattgcaactgttgcacgaataggctgcaggcaaagccaacgccgacgcagatgatgaatacgacgatgcgattaaaccagatggagaaggtcgaacgatgctcatggaccagtcgtgagtcggagaacatcggatccatcggacgattgacaagatcatcgatgagctgaagcgaatcgtcgttggttttacggcgacgtctggtgcggatggcggcggcgtcatccggggaaagcgcatgatgtgattccgcgcctcggactgagtgggagaacacggcgcggcgtcgtaccggctcattctccttgggtacggggaatgagaccggggccgtggcctcaagcgccatacttctcccccagttccttgcgtagcaatccgacgccctgcttggtatagatatatccggcgagccaatacatggcgatgccccagatgccggcggccagcgcggcgatgtagagcaagtggaaaaacgtactggtgcccaaatcggcgaaaatcagaccgacgatggaaatcatcagcagcgcggtaccggccttgcccacgaaatgcacgggcagcggaccataaccgtactgggcaagccatagcacctgaatcgccatccacagatccctcagtcccacgataatcagcatccaccatgggatgatgccggcgacgctgagagccagaatcgagcagaaaatgagcagtcggtcggcgatcggatcaagaatctgaccgatcttgctcacttggttgaatctgcgcgcgatgatgccgtcaagtccgtctgaagccgaggaaatggcgatcagggccagcgccgcaatcatctcgtgcttggagatcagcacgctgatgaaaggaatcgagatgattcgcagcgcgctgatcaaattgggcacagtgaaatagatgtcacgtgcttccggactgtatctggcgttgactttctggttggtcatatcgactaacagtctacatgcgggaggcttgcagagcggtaacgatgatgccgcgtgcgccgacttcgtacaaatcatccatcagctggttgaccttggccttgggaaccatgactcgcacggcgttccactgtttgtcgtgcagcggggagatcgtcgggctttcaaagccaggggtcacggccacggcggcggcgaccttgctgatcggaatgtcatagtccatcagcacatactgatgcgcagtgagcacgccttgcagacggcgggtcagcacggccagacgtgggtcctgctcgttcagacgcggcgaacgaatcaggcaagcttcggagtgcatgagcggttcggcaaacacgcgcaggccggcgttgcgcagggtggtaccggtggagaccacgtcggcgatgagatcggccacgcccagctgcacggaggattcgaccgcaccgtccagatggatggtctcggcctggatgccgtgctcgaccagatagtcgtgtacgagcttatcgaatgtggtggccacgcgcttgccctgaacatcctccagggtggtgatcggggattcgttcggtgcggcgaaacggaaggtcgaggcaccaaagccgagcggcatgtgctcgagcgcggcggtaccggagttcttgagtagatcctggccggtgatgccgacgtcgatggcgccgcggcccacgtatacggcgatatcgagcggacgcaggtagaacaactcgatgccattgtcgggatcttgcacgaccagctggcgagggttggtgcgcagacggtagccggcctcggccagcatgttccacgcgggttcggatagcatgcccttgttgggcactgcgattctcagcatttgcgttcctctcacaggtgcttgtagacgtcttcgagcgtcaggccgtgcttgatcatcatgacctggacgtggtagagcagctggctcatctcctcggcggtgcggtccgcaccctcgtattcggcggccatccaggtctcgccggcctcttcgatgatcttcttgccgatgaagtgggtgcccttgtcgagctcgtcgacggtcagggagccttcggggcgggtctgggccttttcggacagttcggcgaacagggattcaaacgtcttcatgtgattcagattcttttcttgcggttatggatgaaaggtggattgcggttcaggcttggagctcaggccttgaacgcggcctcggccttggcgcggatgtcgtcgatggcttgggcgggattctcggcgccgtacacggcggaaccggcaacgagcacgtcggcgccggcttcggccacgatgtgcgcggtcttggggctcacgccgccatcgacctggatgcgggtcttcaagccacggcgggtgatctcatcgcgcaggcggcggaccttggccatctggttgtcgaggaacttctggccgccgaagccgggctcaacggtcatgatgaggaccatgtcgaactcgtcgaggatatcgaagatcggctcgaccggttcggccggacgcacggcgaagcaggccttgcagcccatctcgcgcagctgtcgggccagacgcacgggggcgtgggtggcacccatgtggaaggagacggaggcggcgccgagcttggcgtattcgggagcccaacgatccgggtcctcgatcatgaggtgcacgtcgaccggcagatcggtgacctgacagatgcggccgacgatcggctcgcccagggtcaggttcggcacgaaatgatgatccatgacatcgacgtggaccaagtcggcgttggcgatggccttgagatcacgttcgaggttgcagaagtcagcggacaggatgctgggtgcgattgcgatattgctcatggtttcctaccttatctgtgcaatgggacttggagccccgtgtttcgcgctgtttcggcgctgtttatcgtggtgtcacttagtgcgattggtttgctttttctggcgaagttgttcctcttcgatgctctggcgttcgagctcgtcggcggtgaccgccgcaagcccgcacgcctgcgccttggggtccggcccgtactggtagagcacgacgaacaggatgcagccgagcacgaagacgatgatcgcggtccacacgttggtcctcaggcccaggatcaccgtggaatagttgatgcgcacgttctcgatccaggtgcggcccaggccgtaccacatcaggtacatggcgaactgctggccggccttgagccggtcggcaagcttgtggccgaggtagatgatgagcgcggcgccaatgaggttccagatcatctcgtacaggaacgtcgggtggaacagcgtggtcctgtagtccgggcattgcgcgccagaatagcagatttcggatttgccgatggcgtccgcgtcgttgagcttcaggccccacggcaacgtggtgggccagccgtagagctcttggttgaaccagttgccgagtcggccgatggcctgggccacgggcagcgcgggggcgatggcatcggcgaagatcgcgaacggatagtgcttgtggcggcaccacaggaacgccaccaaggtgccgacggagatgccgccgaagatggccatgccgccttcccacaccttgaggatgttgaccaagttgccggtgggcgggaagtagtcggccggcgtggtgatgcagtggtagaggcgcgcgcccaccagtgcgcagggcacggtgacgagtgtggtgtcgagaatctggtcgaaggtgccgccgtaccgcttccaacgtgtggcgaggatccatacggccacgcagatgccgatcaggatgcagatcgcgtacatgtggatagtgaacgggccgatctcgaacttggagaaggtcggcgagggaatataagccagattcatcgtgcctctacttgctggtgctcatggtgtgtgtccacgcgcgggttgtgcttgatgctctgtgactaccctaccgtgtcacggcacaacccgcgtgaggcgcaccgggtgtttaccgggcgttgtggatgccttcggccagttcctcgctcttggcggcgagcagcttcaagccttccttcgggtcgcgtgcggtcttgttgtcgtccgcgagcagggtgtgcacgagcgcggagccgacgatgacgccgtccgcgtaggagccgaccttggcgccctgttcggcggtggacacgccgatgcccacgcacacgttctcggcaccggcctgacgggtacgttccacgaggagttcgggcgaggcgtcgatggtggcgcgttcgccggtgacgcccatgcgggcggccgcgtacacgaagccacgtgcgttgcgggccacggtttcgaggcgctcggtggacgagtccggggagaccaggaagatgcggtcgagtccgtggcggtcggaggcttcgatccactcccccgcctcgtccgggataaggtccggggtgatgagaccggcgccgccggcgttctcgaagtcgcgggcgaagcgctcgacgccgtagtggtacacgaggttccagtagctcatgatgagcggcacgccgccggcgttggccacggtttcgacggcctcgaacacgcgcttgatggtctcgccgttgttcagggcgatggaggcggcagcctggatgaccgggccgtccatgaccgggtcggagtacggcaggccgatttccacggcgtcgacgccgtgctcgaccatcgtcttgaaggcgtcaagcgagacgtccgggttagggaagccgtagggcaggtagccgatgaaggcgggcttgttctcggccttgaacttggtgaacatagcgcccgacttgctgggcttgtggctgatgcccagcggctggccggacggcgtggttgcttcgttggtcataatcaaaaatctcctcttcttgttcaggcgacagtattgccgtgggtgccggtcacatcgagcgcggcggcctggtcgtcggtcaggtagccgaaccacttgccggcggtggccatgtccttgtcgcctcggccggagatgttcacgatcatcacggccttgtcatagcccttggccttcagatcggcggcggctttgtacgcgccggccacggcgtgcgagctttcgatggcggggatgatgccctcggtctggctcaggtcgcggaaggcgttcatggcctcctcgtcggtggcccagctgtagttcacgcggccgatgtccttgagccatgcgtgctcggggcccacggaagcgtagtcgaggcctgcggagatcgagtaggtgtcgagcgtctggccttcgtcggtttccagcaggtagctcttggcgccctggaacatgccgagctggccggtgccgggggcgaagcggatggcgtgcttgccggattcggggccgttgccgccggcttcgtagccgtagaggttcacgcgctcgtcgtccaggaaggcgttcatcacgccgatggcgttggagccgccgcccacgcaggcgcagatcgcgtccggatggtcgatgccgtaccagtcctggagctgctgcttggcttcctcgccgatgatcttctggaagtcgcgcaccatggccgggaacgggtgcgggcccgcgacggtgccgagcaggtagtgcgtgtccttgacgttggtgacccagtcgcgcagggcttcgttgatggcgtccttcaggatcttgtcgccaagggtcacctcgaccacttcggcgccgagcatacgcatgcgggccacgttgagggcctgacggcgggcgtcgatctggcccatgtagatgcggcacttgaggccgagcatggcgcacacggtggcggtggccacgccgtgctggccggcgccggtctcggcgatcacgcgggtcttgcccatgcgcttgacgagcagggcctggccgagcgcgttgttgatcttgtgcgcgccggtgtggttcaagtcctcacgcttgaggaagatacgggcgtcgagaccggtcttctctttgacaagtgcggagaagcgcggggcttcggtcagcgggctcgggcggcccacgtaacgctgctggagcgtcatgaattccttgtggaattcggggtcggccttggcttgcgtgtacacgcgctcaagctcgtcgagggcggtgatgagggcctcgggcacatagcggccaccgaactggccccaatacggtccctgatgttcgctgagcggggtcgtttcggatgctttcacttgtgctcctgcctttactagtcgttccactgcaagttcatgattgtcggcggtggccacgccctcgccgaccagtaccgcgtccgctcccgcgcgggcgtagtcttcgacctcgaccgcgccgaatacgccggattccgccaccttgatgacgtcatcgggcagatcggccgcgagttcgttgtatttgttcacgtccaccttgaggttcttcaggttgcgcgcgttgatgccgatcaccttggcaccggccttgcgggcgcgttcgatctcttcgcgggtgtgcgtctccaccagcacggtcatgccgagctcgtgcgccaggtcgagcaggtgcttgagctgggcgtcgtccaatgcggcgacgatgagcagcaccaggtcggcgccgtgggcgcgggcctcgaagatctggtagtcggtgacgatgaagtccttgcgcagcactggaatgtgcacggcggcgcggaccttgtcgaaatcgtcaaggctgccgaggaatttgcggccttcggtgagcacggagatggcgcttgcgccgcccttctcgtactcgcgggccagcgcggccgggtccgggatgtcggacaggtggcccttggacggagacgcgcgcttgatctcggcgatcacggggatgccgtcggcgcgcttaagccatcgtgtcgcgtcaatcggagccggggccgccagcgcggccttcttcacgtcctcaagcgatacggtgagctcacgggcgcgctgatcctccagcgctcccgccaccagttcgtccaaaaccgacatggtcctccctttgttggtgttcggtcatgcgccactctaggtcacgtcctgtcccgattgccgaacccgtcctacattttgggctattcctcgttggttcgtatcgctacggaaccagagcggccaacaaaaaggaaaatcgccatgaatatcggtcatacggcctgggattgattccattgatggcataaactgagcgcatgtgcaggagattcgcgctcgacttggattgggatgccgtggcctcacagttcgcggtagacgaggatgacgtgcgcgttgacactctgccacagccttcctgcaacatcgcacccacgcagaacattggcgtggtcgcacagggcaaggatggccgccgtcatctgaccggcgcctattggtcgctggtgccgcgatggagcgccagcaaagtgctgagctaccccacatataatgcgcgtgtggagtctgcgcatgccaagccggcgttcaccgaatccacaaaatccatgcgagccatcatccccgcttccggctactacgaatggaaaggtcgcaggccgttctattttcacgcgccacatgatgaactattgtctttggccggcctgtactcatggtggaggtcgtctcccgcatcgccatggcagctgaccgcaaccatcatcacctgtcctgccgcggacgagttcgtcaaggtgcatgatcgcatgcccctgctggttcctcggaatatggttgcctcatggctggaccgctccgttgacggagccgcactgttagattccatgcgggaaccgggtaccatgctttctcggcgtctgcaatttcacgaagtcgcgccactgaacagcgacggcaaacgtcttattcagccattggattccaccgaacccatgcgtctgttttgagctcttgcagctggaaccggctatgcagctgtatatgaagacgggtcaatcaacgccccgctgatagctaacctcgtatagccatcagtcaaaaacaggtctcttctgctcgacattggtcgactacgactacttttgcaccaatccgcgcaacaactcgatctcgtcgcgatgcgtggcgggcgtctgctccttggtttcgagaatcatcgggagcttggccatggttgggtcgttgaccagtcgcgtgaagaacgggatgccgagctggccctcgccgatattggcgtgacggtccttgtgcgagccgaggccgaactgcgaaccgttcacatgaatcgccttgaccttggccaagccgatcgcctcatccaactggcgcatcacgccgtcgtagtcgtgcaccaaatcgtagccggcatccaacacatggcaggtgtcgaacgtgacgccgacgttcgccttattctccacgccatccatgatcgtggcgagctcatcgaaattgcggccacattccgtgcctttgccggccatggtctccagaagcaccatgacgccggccgcgcgctcgaacacctgattcagtccctcgctgatcagccggcagccggtctcggagccttggcccacatgcgcgccgggatgaatattgatatacacctcctgtccggcctcgcggatggcggtcagcagctcgatgtcctcggccaacgcctcgatcgcgaatgtgcgcttggcctcatccttgccggccagattgtagacgtacggcgcatggacgaccaacggcccatagccctcagccttcagacgcgcaccgaacgccgccgcgccggccgggtcgagcgccttcgaacgcttgccgtacggggaacgcgggaagaacgcgaacgcggtaccgccctcctcatgggaacgttccagcagcgcattccatccgccggccgtcgacagatgcgatccgatatacagttccatcattccaaactcctcgtgttccactcgctgttcgtgttaccgctatcatatggtaggcggcatcgagcgccgcccgcacaaccgacacgagacacaactgttcacccgaccaaaggagacccgagcatggcggcagccggcacacccaaggacgataccggccttgaacggaagatggagtcgcgtcacctgacgatgatctccctgggcggcgtgatcggcaccggtctgttcgtcagctccggctacgcgattcatcaggcgggaccgttgggcgcgatcctcgcttacgcggccggctccctgctcgtctactgcgtgatggtgtcgctcggcgaactgtccgtggccatgccgtacgccggcagcttccacatgtatgcgaagcggttcatcggccccggcaccgcgttcaccatcgccatcctgtattggctgaactgggcggtggcgctcgcctccgaattcacggccgcagggctgttgatgcagcgatggttcccgcattcgccgtcctgggtgtggtcggccgtgttcattgtggtggtgttcgcgctcaacatcatgtccgtgcggctgtacggcgaggcggaattctggttcgcgtcaatcaaggtgttcgccatcatcgcgttcattgtgatcggcctgctggcgatcttcggcgccataccgattgccggtcatgattccgcgccgttgctgggcaacttcgtggccgacggctggttcccaagcggtatcgcgccgattttctcgactctgctgaccgtggtgttcgcgttctccggcaccgaagtggtgggcgtggcggccggcgaaaccaaggatccctcgcgtgcgattcccaaggccgtgcacaccacggtgctgcgcctggcgattttcttcatcggctcgattctggtgatggcggccttgatcccctggcatcaggccggcgtggatacgagcccgttcgtgctggtgttccagtcaatcggtatgccgttcgccggcgacatcatgaacttcgtggtgctcacggccgtgctttccgccgcgaactccggcctgtacgtgtgttcgcgcatggtgtggtcgctggccaaggagcggctgattcccgaacgttttgctaggacgaatttccgtggtgtgccggtgtgggccgtgctgttcagcatggcgggctcactgctggcgttgctgtcttccgtgatcgccgcctcgaccgtgtatctggtgttggtcgccgtgtcaggtttggcgacgctggtggtgtggttctccgtatgcgtgtgccatatccgtttccggcgcgaatgggcgcgggatgggcacagcgccgatgagctcggctatcgtgcgcccggtttcccggtgctgccgtggctggccatcgtgatgtgcatcggcgcgctggtgctcgtggtgctcgatgatacgcagcgttcgaccctgtattgcatgatcccgttcgtcgcctgctgctacgcggcttattacgcactcgaacggcagcgcaaacgcgaaaacaacgcctaactcgatttcgaggggctgatttggcacttgccggagatctatctccgtttcaaggggctgatgcccgagtagacaaggctccacaatggcgtaatggcgttgccgcaaagccgtttatactcgcggtttggcgtttgagcagcccctcgaaagccaagtagatgtccccaccggacgaaatcagcccctcgaagccgagaaaccattgatggccgattatgttgtgcccagtgacgcgcctggttctatgctcgaactggtacaataattggagtttgttttttgcaaaggggcattgttatgtacaatgtgttggtgtcgttcgcagacagctaatgcgcgttgactcgtcgcgctaagccgtggtcgccgtttgggcccacggcacttctgttgtgccatttcccacgcacttggtcgaaggctggcgatgggccctgaccaaaaggaatttcctctccgcaatcatgctcggcgctatggtgacatcgactgcgtagccagtatcaccggcgcgcagatcatgttggccgcccgtggcgccaacgcggtcatgatcggactgctcggcacggcaatgggcgtgagtactttggtcggctcgctgttggccaacaagctagtcgatatggttcccacggggaaactgattgcgggcgcgctggcgttgttcgtggtcagccagatgccactgttattcctgcacagctacgcggccattctgatctgccagattctggccggcctgccgttccccgcgttgaacgctggtctgctgggctttctctacggcaagacacccgacaacatgcaggggcgggcttctgccgtatttgaaaccacggtcggcatactgggcgcagcatgcccggcgatggtcggctggctgttgcaacagccagatctcggtttcacggcggtgatggccgtagccgtggtctgttccgtagcgggattggccgtatcgttggccggcccgctgcgcagcattccgaatcccgaccagtggtcggaggttttcctgtaacgccaagcagcggagcgccggtttatatcaggtcgtacggcatctgacgcttgaccagccagaagatgccgaggccgatgaacaccagcagattgaatccgccgctatgccaccacaccacggcgatcagcgtcgccatgcgcgccacatagaacgccacgcgaagccgcccttcgcgcggccgggtctctatcgtcatgtgcgtgaaactgccgccgaacgtgcagccgccgcgcaaccatggcaccacgccctcgaagaggatgagcgccgccaggaagaggatcgaaccggtccagtcgaacggttccatcgactgccatgagccattggagcccgagggcaggtttgagcggacgatcatgacgaacagatgcgtcggcatcacggcgaacccgatcagcgtcatgtcgatgatgaacgtgatcagccgccttatgaagccgggtgtggtggtcggcgtcgtatcggcgacccgcgccggaatcaggcgcagcgagaacatggccagcgcgaacccgatcagcgcgccggttgtgttccacaggagatcgtccacgtcgaacagacggtaggcgcacgggaacacgccactgccacaaaggaacacaagccaaaacggacacacattttggcctataaccctttgttcttgcattttctgcgtattgcaacaaaaagatgacgacacgccgatagcgtatctcacgagaaaagtcttattgcctcacgactgtcgaggccaccggaagtcggcataggcattccaatcggccactaaatcgaccgatgcccgatccctgagccaaacggacccgaatgccgttcatcatcgacaaagcagtccgcgcctcgcgacgaggatctgccaaaccgtcacgctcgactgctcgggttaaggtgtccatcacgcgatgttctcgtttttggtaatactcataggcaggatgatgctcgttcaacgattcgccttgtagcacggtatatacaaccgcaccatctctggctgagccgcattgcgctccataagggcagcacagatatcacgaatgccgaactgcgcgttgccgctccacatatcctcaggttcaacgccaagagaatgggcaaaacgtagccatgtcttcccgatcacgatgctccagcacggcaatcagcaagccgactttgttcttgaaatggtatatgaccgccggctcggtcaatccgcatgcttcggctacctgacgaacggaaaagccccaaaacccgttctgtgaatcacatgcgacgtcacgtcgatgatctgttcacggcgttccgcacattctgattctgctcaagacagatccagctcgttgttgtccttggctttgctcaccgtatcagtcaaatcggggtcgtccacagacaccgcgttctgctggctgagcgtcaacgacagcgaacctttgtaggagtcgccgtattcgtccttgccggacacgcttacggcaatcgagctcatcagacgcttcctgccgtagttcagatccacggtgatagtcggcatatccggctcttcatccgtgccgaagtcccagttgcgcacattgtcgagcgcctgacggtactcgccttcagcatcgcccacaccggtatcctcgatctgctgaatcacccatgatttcagatgcggatactgcgcttcatggctgatccagtaattcacaaagtgctgggccaatgccttgacatcgatttgatacgagagctgcgtgttgccggcagacttggcagacgatgtattcgggaacagctggctgcgcacattcttatcttccagctccacgccgagatattgttggatgaatttgctggcctcggccttcacctcggcagacgttttcgtgcccttggcccggtcgatgtcgttcgagtacccatcgtcgttcatcttgtccagctgatcgtagaacgttcgctccgcgccggtgatgtcccaagcaccgttcttgaccaacgcatccttgacgttcaatatcaagtccgccacatcactaccaacgccgttccttaagtcatcttcatattggtcggccgggtagtagatgtagtaggggtcgtcatcataccaaacgtttttcccggcgaatgcgcctttgtgccaagcgagggttgttgcctgttcatctgtcttgatggtcacagacgcggaggagtcattggtggttttgccccagcgaatacatgccagacatccgcgcgtcaagggagtcgtcagtgctgctgtgggttctgagttcgtatttggtgctgcgcagagtggacagcgagttgatcgcgtcgaaggtgacgaccagcggattggtgggctggaagcccagcatcgctttgacggcggtgaagttggggacgatgaatgccaaggccgccaccagaatcgtcgcaagcaatgcgcagagaacggcgatcagcttcttgctggatttgcgcggcggtgccaggacggcggttgcatcagtcgcctgatatgcggcaggagcgggaatcggcaaagctggcaagggagcagttggtgccggctgtggggcagcgggcgcggcgtaaaccgatggggcaaccagcgcggctggtatcgatggtggtactgaaggcgctggcacagcaggtgccggtatcgacgcagtcggtacggctgacgatgcggccggcactggtacagacgcaaccagtgcgctgtctacagacgctccacatgccgggcaaaatcgtgccggcctatcaactctatttccgcagtggccgcagtacgccatcgtgtgcttctcttcctcaaatcggcttgattgccattgcttcaatgttactcttcagcattacgcctcagccagcccctacgcgtaacgatacgagacgcggcagccttaatgcggttgttttgacgcgatgccaacatcgagctctggccaacgttctggtactcggctacatcttgctgcgagccaagaagcaggccatcgctcgcgccgacgaggccgaatggcggcctagcctcgctttaagcctcaggccagcacctccatggggtgataggtggcggtgtggtggccggtgatggggttccatacccgttcggcgaatgcgcgcagacgggcgacgccctcacgcagctcgccggcatctccggcgtaggagaggcgcacgaagccgcgcccctcctcgccgaaggcctcgccggggaccacggccacgtgctcttcgtccagcagacggtctgcgaattcaccggagtcaaggccagtcaggcgtacgtccacaaaggcgtagaacgcaccttgcggttcaatcaagcgcaataccgggcatccggccagaccgtccagcacgatctggcgcttggcgcggtattcctcgcgcatggcggccacatgatcctgcggaccggccagtgctgccacgcctgcgtattgcgccaaggagttcaccgaggagtgcatgagttcggcgattttaccggtctgttcgatgaccgcttcgggtgccagcaggtagccgatgcgccagccggtcatcgcgtaggttttcgacaggctttccaccacaatggtgcggtctttcatgcccggcaccgcggcaatcgatggtgccacggctgcctctcccccaagcgtttccccgaacgtttccccaaacacgaacggatggtaaacctcgtcagagatggcccaaatattgtgctgcttgcatacttcggcaatacgcgccagttcagcggcagaagttaccgcgccggtcggattgccgggtgagttgatgattacggcgcgggtgcgcggggtgatcgccgcttcgatgtccgccgcgttcacgcgcatgccgtgctccggacgcagcgccacggtgaccgggcggccgccgcacagcatcacttcggcgtcataggaagtgaagaacggcgagggaataatcacttcatcgccggtgcctaccacggctttcagcgccagaaacaggccaatcgtggcaccgtcaacggcttgaatctcggtttcgggatcataagtgagtcccttcacacgggcggagtaatcggccacggccttgcggtattcggggacgccgagcacgttggtgtaccgagtgcggccagcctgtgcggcctcgcaagcggccgccacgatatgcggcgcggccgtggcgctgggctcccccacggtcagtgaaatcgcgtcaggcacgcgctctacacggtcgaatacgtctcggatgccggagcgcgggatattcagggcttcggcggacaagctcgcgggcttggcggtcggcacagcaacccgtctgacagcaggcacagcagcagatgcaacttcggacagaggcatgttggaaaacttctgcatatcatccctcctcaatggaattatttcgtcgttctcttatttcagaaggaattattacattcaattaggactttaggcataaacattccaccacacaacagaaaacacaggaagaactactgaaattaccaggcaaaatcggaaagccatcgcattccggcaacaggtacagtgaacacagagcacaacgaacggagaagacaccatgaccgcgattgacgagaccgaccagcgcatcctcaccatgctggaggccgacggccgcgccacgctcgcgcaactggcccaggcgaccggactgtccgtctccgccgcccagtcgcgcgtgcagaagctggagaagcgcggcatcatcaagggatacaaggccatcatcgaccaagagcagcgcggcttgcccatcagcgcgttcgtcaacgtgaccccgctcgactactcagccgaatcctcgattccggacaagctgaacaatatcgacggcatcgtctcctgctattcggtggccggcgcccccagcttcgtactggtggtacgcgtggcctcccccaccgcccttgaggaattgctcaatctcatccaccgcacggtgccggtaagcaccgagaccacgatgattctgcagacctacttcgcgcactgaccgcgaacccggtaacctgcgcgccgaagacctcggcccctacggcgcacgattcccaacgggcacatccgacatcacccaagtccacctttatgtccactatatgaacgcaccttcggtgtgatgcagcttccatttcgacccgattcacgcacagacagacatccagcaatcgccgaaaaatctaacaaacggaaacttgaaccaccccataaccacgccgatagctttcccgttatccgagcgagactctatgcagcaagggcctgcgcgcatagaataaaaccgtcttaattccctagcaaatcgaggagaatcatgctcactgacgagtacatcaagcgtgtctacgaccaggtcgttgcccgtgacggcgatcagccggagttcctgcaagccgttcgcgaggtcttcgagaccctgcagccggttgtcgagaagcacccggagtacgagaaggccggtgtactggagcgcatcgtcgagccggagcgcaccatcaagttccgcgtggcctgggttgacgacgagggcaaggttcaggtgaaccgcggctaccgtatccagttcaactccgccattggcccgtacaagggcggactacgcttccacccgaccgtgaccgagtccgtcgtcaagttccttggcttcgagcagattctcaagaactccctgaccacgctgccgatgggcggcggcaagggcggttccgacttcaacccgaagggcaagtccgacgctgaggtcatgcgcttctgccaggccttcatgactgagctgagccgccacatcggccagttcaccgacgttcccgccggcgacatcaacgtcggtggtcgtgagatcggctacctgttcggccagtacaagcgcatccgcgacgagtactccggcgtcctgaccggtaagggtctggaattcggcggctccttggcccgcaccgaggccaccggttacggcgtgtgctactacacccaggaagccctgcgcgtgctgcgcaacgactccttcgagggcaagaccgtcgtgatctccggctccggcaacgtggccacctacgccgctcagaaggctgagcagttgggcgccaaggtcgtcaccgtctccgactccaacggctacatctacgacccgaacggcatcaacgtcgaggtcgtcaagcagatcaaggaagtcgagcgcggccgcatcaaggaatacgccgagcgcgttccgggctccgagtaccacgagggcagcaagggcgtgtggaccgtcaagggcgacatcgctctgccgtgcgccacccagaacgaggttgatggcgaatccgcacagaagctcgtggacaacggcgtgaccgtggtcgtcgagggtgcgaacatgccgtccaccccggaggccatcgaggtctaccagaagaacggcgtgctgtacggcccggccaaggctgccaacgccggtggcgtggccgtctccggcctggagatgagccagaacagctaccgcctgtcttggaccttcgaagaggtcgacgccaagctcaagtccatcatggaagaaatcgtcgccaactccctggccgccgccaaggaatacggtcacgagggtgacctgatgctcggtgccaacgccgcaggcttcgtcaaggtcgccaacgccatggttgcccagggcgtgctgtgacgcttgccgctgagcaatcgctgagcagtgctgagcaatactaagcagtactaagcagtagcgtaatgcccttgcttccccgtgaggaggcaagggcattgctatatgtacaacgagcaacaagtgctatcccaaatacgtaagcattacgcaccactatacgagtgaattcttggatatgatcatcgatccaagctaactgcattcagaggggtactgaatatgggaaaccccgagtataaacgccgtcattgcaacgcttatactcgaggtttcgtggttcaggtacccctttgaaagcagttggctttctgcaaagccatcaatgtacctctttcaacggagatagccccccgtctacaaggtcaccaggtccggttcgcagcaacgctttcaatcactgctggcgattgcggcgcactgctaccagcgccaagccagcaacgagcagcggcacggcgactacaaccaccgcaatgatggccgagccggtttccggcatggtgtcggccttggccgccgaatccgcgttaggcgaggcgttgccgcccggctgagtcggctgcacatcagtgccggtcgagtagttcgggtcgtaagcgaatggccacgcgccatccggcacaacccactgaccagccgccgagccgaagcccagtgccgcgagcaattcagcacgcttcgcctgcacctgagcctcatccaaagcagtcatcgagccgagcacgacgttcttataatcagccggatcaagcagcgcgccggtttcatcgtggctggcgtattccgcgaatcgcacatcatcgtggaaggtcacgtccacgcttttgccgctctggttcttgctggtccacacattccaacgattcttggtgatcttgctggacatcgtgctgtcgaggtaggtcacggccgaggaagtgtccgtatacgccgagttcttcgtacccaaatccacgccggtcacatagctgctgccgtcgcccttacgcacctgcgtgtactgcgcgaacgtctgccacgggcggcccagcgaaagcttggcatcgtcgtcatatgctgcggcaacggtcaagttgcagcggtcaaacaccaggcccacgccggacttcttggtgttggcggcggtgaagtagccgttgttcttgccggcgaacgcggccatgtgcagctcggtgccggcgaagtaggcgttggcgtcgccgaacacgaaatcaaccgtgccttcgatgtagccgccgtccacgtacacgcggttgccggcgccctgcacgtacagagtgtcctgacggccgatgatgcggctgttcttcaggtacaccttgtctgcctgggtgttcagcgccacggccggcgtctgctcgcccgccgccgtgtgatccaccacgttgtaatcgttctggaaggtgatgccgtaggcggagaaacctgtggcacccgcgccaatggtcacggtggcgcacttgttggtgccaaggtcgaattcatcctgcggcacaaacttgccgtcggcatcgaatgtgttggacgaatagtagctggcgcgaatcgtcaccgcgcgcttggcggtcacgtcggcgttggcgaaggtgacgcccggcttggtcacggtgatcttctcgcgatagtcgcccggagtgatcttcagcactagtcggtcggtttcggaagagtcgttagcatccagagcggcttgaatggtccggtactggccgttcgggcccacggtgaccgtgtggctggtggcggcgggggagccggccgcgtagtcgatggcgatgccggtcaggtacaggctgcccgtgccttcaacggagagcggcacgtagcgcgtgctgtcggttgcgatggttacagcagtgccggtggtgatgtccgtaccgtcgagcttgagcgtaggaccgtacagctggcccttcacggtgactgtagcgccgccctcggcctgtgcgaccggaatgtacaggatggttccagcgttcacctgagtatcgctgccgccgcttgccgcggtagtacgcgggttgaacttggcgccttgcgcccgagcgtcgatggcgacgccttggtagttgtcggtaggccctgcacggccggtcgatcgatgccggtttccgtgaagtcccagttcgtgtctttggccgcgaccgtgggcgtaccggggaactcgggttccggctgctgttcggcaagggcgatgccgttgagataggtctgggcagtgaaggtgacgtttaccgtacgagccgactccgcagcaggcaaggcgataactgtgttgtcgctgctcacttcaccggcatccgcggtaatagtggtggtgccgccggacaacgcaagggtgatggtggctgtattggtgtgggctggcaccgggatgctgatgatggttccggcgttgatctgggtgtcattggcgcgcggcgcaaacttggcaccgtttgcagtggcatcgatggtcagcccgtcgaacgtctgggatccgccttgtatagtgccgagagccgccagctcagtgttgttcgcaggattcagcacccattcgcgattgatggattccgcggcttgcgtgctgctggtggtgccggtgctcggcgacgttgcttccgcggccgatgcagtggctgccgcaccgccaaatatcatgcttgcagccaacagcacaccggcagcacgaataatggtgtttttcatgggtgttctctcttatgtatcgatgtacaacaacgaaagccgctttcggaacacccgagtcggttttgcagcctgaaagcagggcttcacctgctgaggggaacacgactatcgggcatttcccagcctgtcttcgcgttcaaaatatcaccgaaaaaaatgcgactggaaccccgtagcacaacaagaaaaaagggggtgcaccccatgtgttgggatgcacccctaagtggtcaataagggggagttggaatgggactcatgaccccccccccagcggcgccaagctgccacacgctggcagaccaacaccactgtgtgcattctctgcgtcggcggcagtccaaaacttggcccagcaacgacgcttgctgtgcccagcgtcggcagagggccaagaattggacgcatacgacacagaacgcaccctcagcgtcggcagaactccaagatctgtaccgctgacgacggtaagccctccacagcgtcgtcagagatacaaaatctgtcccaacaccgacgcctgccacccccagcgtcgccggagtcccaagtctcggcccagcaacgacgcctgcgatccccacacataagaaaccgcacctccgatcatcgaatctgaattacttcagtccaacaaccggggtgcggttcactgaggagagttccgtcagtatagctatatcagtcgtcgccgagcgtaacgtgcacaccgccgaccagagagctgaccacgttgtagatcagtgccgcaatggtggccagcagagtgaagatcaccacttcgacaatcgagaagatggtgacgccggagaccacggtggtaagggacaacacgttcttgagatcgaaaccgcctgcatcaagaccggtggaagacacaatctgcgtaatctggctgaatacaccgaccacatcaagcagcacccatacgatcgcggaggcaacgacctgaataatcgccacggcgatggacagcatgaacgtcaccttggccacggaccaagcatccacgcgggtcagcgacaagctcatgcggcgagccctgggggcgctacggcgaggtgccggacgcacgggagtggcggcacctgaagaaggcaacgcggattcttccggatcgctggacacggagcgtgccacgcggggagcgtgctcagtaccgatcagcggctcgacatgctcgttctgcgtattgccgactgccggcggtatgatccggggctcgttgtcttcgagattctcgctcatcgtttctccttaacaggcttggcggtagcctctgctgtatgcgaggctaccagcttttcaggacgctgctcacgcctcgtccgcgttgttcacattctcgccggattgtgcggtctcggcggtgccgttcgccgcggcatcgccgccatcctcgggctcgtccttctcctcgttacgggcgatggagagaatcgtgtcgcccttgtcgggcttggcaaaggtcacgccctgggtgttgcgcccggtgcgcttgacttcgtccacgttggagcgaatcaccttgccggacttcatgatggccataacctgatcgtcttcggacaccacgagcgcgccgaccagagcaccacggccctcgaccagttgcacggccttgatacccaggccattgcggccctgcagacggtattcgctgatggcggtgcgcttggcgaagccctcgttggtgaccacgaacaggtccttgtcggagtcgccagggaccacatccatggtcagcaggctgtcgtcgttacggaacttcatgccctgcacgccggcggtctggcggcccatcgggcgcagctgctcgtcgtcggcctggaacttgaggctcatgccgagtttggagaccaggatgatgtcgtcctcggcgttgcacagcgcggcgccgatgagctcgtcggcgttctcgccgttctcgtcggccatgaggcgcacggcgatcaggccgccctggcgcggggaatcgtactcggccagcggggtcttcttgaccttgccggaacgggtggcgagcaccagatacttggccacctcgtagttcgggatggacagcacggtctggatggactcatcaggcgcgaactgcagcaggttggccacgtgctggcccttggagtcgcgcgagccctcgggcagctcgtaggccttgatgcggtacacgcggcccttgttcgtgaagaacagcagccagttgtgcgtggaggtcaggaagaagtgatccaccacgtcgtcctcgcgcagcttggtgcccttgatgcccttgccgccgcggtgctgggagcggtattcgtcggccttggtgcgcttaatgaagccggagtgggtcacggtgaccaccacgttctcttcggcgatcaggtcttcgacgttcatctcgccggagaacggcaggatcttggtgcggcggtcgtcgccgtacttggcgacgatctcgtcgagctcgtcgccgatgatcttgcgctggcgttccggcttggcgaggatgtcgatgtagtcggcgatcttgcgctgcaattcctcatgctcggccacgatcttgtcgcggttcatgcgggtcagcgtgcgcagctgcatggccaggatggcgtccgcctgcacctggtcgatgtccagcagccccataaggcccgtacgtgcggtgtcggtgtcttcggaggcacggatgagggcgatgacctcgtccagcatgtcgagggccttcagatagccctgcaggatgtggtcgcgctcttcggcctcgcgcttcaggtacgcggtgcggcgggcgatcacgtcgagctggtggttcacccaatggcggatgaaggcgtccaggctcagcgtgcgcggcacgccgtcgaccagcgccagcatgttggcgccgaaggtctgctgcagctgggagtgcttgtacaggttgttcaggaccaccttcggcacggcgtcgcgcttgagcacgagcacgaggcgctggccggtacggccggaggtctcgtcgcgcatgtcggcgatgccctggatcttgccgtcgcgcacggactcacgaatggagacgacgaggcggtccgggttgacctggtagggcagttcggtgaccaccaggcacatacggccgttgatctcctcagtgttgaccacggcacgcatggtgatcaggccacggccggtgcggtaggcctgttcgatgcccttgtggccgaggatggtggcgccggtggggaagtccggtcccttgatgatgcggatcaggttttccagcagttcctcgcggctggcgtccgggtggtcgagcgcccagtggacgccgtccgccacctcgcgcatgttgtgcggcgggatgttggtggccatgccgacggcgatgccggcggagccgttgacgagcaggttcgggaagcgggccggcagcacggtcggctcctgggtcttgccgtcgtagttgggcacgaagtcgacggtgtccttgtcgatgtcgcgcaccatttccatggccagcggggccatacggcattcggtgtaacgcatggcggcggccgggtcgtcgccgggggagccgaagttgccctggccgtcgacgagcatgttgcgcatcgaccaggactgggccatacgcaccaaagtgccgtagatggcggagtcgccgtgcgggtggtacttacccatcacgtcgccgaccacgcgggagcacttgttgtagccgcgatcggggcggtagccgccgtcgtacatcgcgtagatcacgcggcgatgcacgggcttcataccgtcgcgcacgtccggcagggcgcgctcgacgatcacggagagggcatacgccagataggactcgcgcatctcctgctgcaggtccttgcgctggatgcgttcgccggtgtccatcaggccgtagtcggtagtgtccgcctcctgcgggctcaacggctccatcgagccgtccggcgtgaactgctcgtcgccggtgttgttttcatctgccactgttgttcctttagttgtctaagtccgttgtgtacctccctctgacgagggaggttggaggattccgctacgcatcgatccaacgcacgttcttggcgttgcgctggatgaagaggcggcggggttcgacctcatcgcccatcagcatcgagaaggtctcgtcggccgcggcggcgtcctcgatgtgcacctgcttcagaatgcggtgctcggggtccatggtggtctcccatagctcctggtagctcatctcgcccagacccttgtagcgctggatgccttcgcccttgggcagctggcgtccgttggccttgccttcggcgagcacgcggtcgcgctcggcgtcggtgtacacgaagtcgtgcgggcccttggtccacttcaggcggtacagcggcggcatggccacgtacacgtagccggcggtgatcatcgggcgcatgtagcggaagaacagcgtcaggttcagggtggcgatatgcgcaccatccacatcggcatcggccatgatgatgaccttgtggtagcggaccttggagatgtcgaagtcctcgccgtagccgccgccgaccgcggtgatcagcgattcgatggtgtcggacttcatcatgcggtccaggctggcgcgctcggtgttgaggatcttgcctcgcagcggcaggatggcctgcgtgatcgggttgcggccctggatggcggagccgcctgcggaatcgccctccacgatgaacagctcgcactcttccgggttggaggactggcagtccttgagcttgtcgggcatgccggcggactcgaagatggacttgcggcgggtattctcgcgggctttcttggcggccagacgggcacgggaggcctcgatggccttctggatgatgttcttggcctcggccgggtgggcatcgaaccagtcgccgagcttgtcggtcatcacgcgctgcacgaaggtcttggcttcggagttgccgagcttggtcttggtctggccttcgaactgcgggttggtgagcttgacggagatcacggcggtcaggccttcacgcacgtcgtcgccggagaggttctcgtccttgtccttgaggatgcccttgtctcgcgcgtaacggttgaccagcgaggtcagcgcggcgcggaagccctcctcatgggtaccgccctcggtggtggagatcgtgttcgcgaaggtgtgcacggcctcggagtaggcagtggtccactgcatggcgagttcggcggagatgccgagcttcaggtcttcggcctcgaagctgatgacgtcctcttccaccggcgtggccttgcgcaccttgaccagatagtcgacgtagtccttgatgccgttgaggtactggtaggtgacggtctggtgctttgcgccgggctcgtccgcggcgtcgccggccacctcgtcgccggcctggtcgttctcacgctcgtcggtcaggctgatcttgaggcccttgttcaggaaggccatctgctggaagcgggaacgcagcgtctcgaagtcgtagatggtggtctcgaaaatcttcgggtcggcccagaaagtcacagacgtaccggtggactcgccttcggtcatcggctcgccctgcttcaagggcgcggtggggtgctggtcgatgtacgtctgggtccagtggaagccctgacggcgcacttcgatgtccacgcgggtggagagtgcgttgaccacggagatgcccacgccgtgcagaccgccggacactgcataaccgccgccgccgaacttgccgccggcgtgcagcttggtcatcacggtctccacaccagagacgccctcgccgggcacctcatcgaccgggatacctcgaccatcgtccaccacacggatgccgttgtccggcagaatggtgatctcgatatggctggcgtatccggccagcgcctcgtcgaccgagttgtcgacgatctcatagaccaggtggtgcaaaccgcgcgggccggtggaaccgatgtacataccggggcggatacgcacggcctcaagtccttcgagcaccctcagatcggaggcctcataatgctcgggggccatggattcgtcaagttcgccttcggtcaattccgcattgttgatgcgttccgcagccgccttcagctgctcctctttgctggtttcgtctgccaacaggcttccttccgtgactacagggtcaacctccgtcatgaaggtcattcacggaggcgatatggcttacgaggcccgtaaagggctcttctagccatttgaccatactgcatgtgattttactcgtctaacccgacgagcgccatagcgaggcttctgcgaatttgtttggtatcttggctaccgccgccgagcccatttgcgcgtgtatccggcggccgggccggtcacgcgaatctcggtgatggtcaatcctttgagattgcgacggatggtatcggtgagttgggggataaggtaggtcagctgcgtggcccagaccgtggattcggcgcggatggtcagtacgccgtcagtgaaatcggcgactgccgaatggctggcgatggcctgacccaccacttggtcccaatggttgcgcaattgcgcaagcttcatattcgccgtccagacgccgttgccggcgatggtggtcatcacgctgcccagttcagccggatcgcgccccggtttgccgaagttttcgatggcctcttcacggcggcgtctgcagtccttcaaggtcgccccgcgacgggagagccgctcgaatatttcggccggcagtttggtctcgtccaggttgagttggcgggcgatcggcgggttcatgacactttccgttctacggacgcgctgtccaccgcggttttttcgtcatacccacccaaactctcattttcccgcgaattggacaaattgcccagagttggcaatatcacggaagctggttcgtccagtgcggccacgtcgatgcgatgggccgattcatagtcgggcacatcgccttcagcggccacggtaatcagcacctgatcctgttttctggcgaaatcaagaatctgcgtgcgccggctgtcgtcaagctgggcgaacacatcatcgagaatcacaatcggctgcaatcccaaccggtcacgcactatttcgaacaatgccattttcaaggccaacgccatcgtccacatctcgccgttcgaagcgaactcgcgggcgggaataccgcccaactcaaggttcatgtcatcgcgctgcggaccgataaggttcacgccgcgagccacttcaccggggtagatgcgttggaaatgctcgctaatctgcggatgcggatcgtcgaacatcagcacttcgtcgaatgaaggcgcataagtgagcgtcacctgctcgccggcaccggccaagtcggcgtaaatcgcggcaaatggctcggcaagcagaccgatcacatgagcgcgcatacgggtcaacgccacaccggcttcgatgaactggccggtccagatttccaaaccgctcagaaccgcatccatcggctggccattgttgacattggcattcaattgcttcaacaatgtggcacgctgtttggcgatgcgcgtgaactgttgcaacgtctgcatgtatccgggctcgagcagagccgcagcctgattcatcatggtgcggcgtgctcccggatcgccggacaccaaccgctgatcttcgggagtgaaggaaacgctgggaatcttgccgatgatatcgcgcagatacagcgacgaccccgagttgatgcgggctcggttggcaccacgcgcatgaattgacgcttcatacgtagtggtttgaccggcatcatcagcgacgttcgcgcggatagtggccgtggtctgcccgcgttcgatcagcggcaacgtgctggacgtgcgatggctcgatccggtggacagcacttcgacggcttccaccagattggttttgcccagaccgttcttgccgaacaggatattcacgcctggtacgaaatcgaccactacctgactccatgagcggtagtggtcgagtgcgagacgggagatgtgcattagcgaatcgttggaaattcagggatttcagttgttaaagcgcatcggcacgagcaggtatcggtagtccatggactcgtcggaatcagcttcctgctggccattgaactcgaccggcttgaccggggtcgtcattttgatgcgcacgaatggttcggttacggcggacagaccctccttcaggtaggacgggttgaatgccacggtgatgtcgtcgccatccatgtcgatgtccagtgtttcgttggcctgagcctcgtcgaccgatccggcggacagcgccacttcctgaccggtgaaggtcatgcgaatcggagcattgcgttcggcgaccaaagccacacggctgatggcgtcgagcaaatcctgcttgttgactacggcctgaatcggatattcgtcggcgaacaggcggtcgaccgccgggaattcaccgtcgatgagctgggaggtggagacgcggccggcgttttcgaagccgagcagcgtcgggctatcggcatcgaaatcaaggcggatgttctggtgctcgtcaagagcacgggccacatccttgagcagggagccgcgaaccagcgtggtggtgtcgacgtccgggttctgcggagtccaagtgaaggtggcgcgggccaaacggaagcgatcggtggaggtcatgacgaccttgtcgccttggaattgcatgcgaacgccggtcagtaccgggcggttttcttcgcgggagacggcaacgcacgcctggttcacggcctgaacgaaagtcggggcatcgacttggccgagcatggccggtaccacaggcagatccgggtactcggtgtcgggcatgagctgcaaggtgaacttcgacttgccggacgtgatggtcagcgtggagccgtcggtgaccaggtacgttttctccgaacgcagcgatttggtgatatcggccagcagcttgccctgaaccagtacggaaccggcttcgtcaacgccggcttcgatgtggtggcgagcggaaatctcgtagttgaaggcggagaattgcagcgttccgtcaatggcttccagcttgacgccagcgagaatcgggttggagggacgtgcgtcgatgactcgggaggtccaggctacggcgtcggccagggctgcggtatcgatttcgactttcatgtgtgattgttcccttcgtcggattggctgagaaatattctagccgttaggtggcgaacttacgtacgctggatgaccggctgttactatggcgatgatgctttttcacgtaactgagtaagtaatcgccataataaggccggtggatagtgtggataagtagggctgagccctacaactgcaacggttcataagtccctgaaaattgtggacaaattctgcatggcttgtggataagtgggcgagttttccacagccagttcgtcgaatttgagttttccacatcgaggtcgcggttatgcacgagttttccacaacaaaacagtgggtaatccacgagttatccgccgagtttacccacatctgtgcacaactatgtggataacttttttggttttcgcactttcgcacggcgtgttgaagactgtttttcgtcgaggagaatcgattctggagaccgttttcggcacttttccgtctcgctcgcccaaacccgcaaaatcggtcctcagaatcgattctctcgtttcatggtttttttgcgtgttccccttcgaaactcccctcagtcgtctgcgccgacagatcccctcacaaaggggagccatgaggaatctaatgtctcgaatccgttgcctcgacgtatccaccagaatccgcctgagcaaccaaaaacggcacttttcggaaagtcagtccaaaaagtgccgtttttcgtctctcagaagcgttgtgtcagttggtgttgctttgcttgaggcgaaccgtgagctccataacgtagttatagatctcctgtttttgctgcattcggtcactgattcgagtgcaggcatgcattactgtggtgtgatcgcgtccgccaaagacctggccaatatccatcaggctcatactggtcatttcgcgagccagatacatggcgatctgacgaggaacagccacgtttttggttcgtgatttaccgacaagatcctcaaacgtcaggtggaagtacttcgccacctgactgatgatgtccgtgggcttgatttccacatcggtggtgaagaagtcctgcaacgtctgctcggccaaggcgcgggtcaccggctgattactcagcgaggccacggccgtaacacgggttagcgcgccttcgagttcacgaatgttctcggtgaagcgttcggcgatgaggtccaacacatcgctggggattttcgagccgttcatcgaggcgatcatgcgaagaatggcgattcgggtctccagatccggcggcttgacgtctacggtcaggccggattcgaagcgcgagatgagtcgagcctcgaaacccttcaaattcttgggcgctacatcggaagcaatgacaatacgcttatttgcctgatgcagtgcattgaacgtatggaagaactgatccaaggtggcttccttgccgccgaggaactggatatcgtcaataagcaacacatcaacctgtcggtatcgacggttgaattcagcaatctgcccctggctttggttcgggttttgcagcgcgtcaatgaattcgttcgtgaattcctcagacgtgacgtatcgaaccttcagcccgggatccttgaccagtgcatagttgccgatggcgttcagcaagtgggttttgcccaggcccgatccgccatagatacacaacgggttgaaatcctgcccggaaccttcggccacggccagtgcgaccgtacgggcaaaacggttggaatcgccgggcacgaaggaatcaaacgtgaagttcttattgagatgagtctcgggatcgcgattcatcttctgctgaccgaccgggaactgcggctcggtggcgggcatcggttcccgcggtgcggctgccggctttgcaccataggattctttaccgaattcggcgacagtcggagaaatttccgaaggatatggctgcgccggctttgcctccgaaagcggttcgggctcggttttcggcacgaccttgaacgcgggaaacatattttcgccggttaccgtacgcaatgcctgaagcagggaatcgttcaaatcaccctgaatggcttgaagcgtgtcgttgttgtccacacacagcacgatggtcgaaccgaagacgccttcaggaacaacgccttccaaccagcctttttctcgtgggctgagcgaagcgctgtgtttgagcaccgtcagcgtgtctgaccagatgtgggcggcctcgattacggggtcgccggaagcgttaaccatggtggccccttctgtcgctgtggcgaaatacgtacaacagataatatttactctggtttagacaagttatccaccgtgtcgcgtgttgaaataactggattgtgaataacaaacatgtaatttgtggataacttttggccgtgaatggttggtattccgccgattataagagatttggggcgtgtctcgcaacgtgtcgaaatgtgaaaatactccgtccgttttgacttgagggtaggggtgagagtactttggtatagcttgactcacgtgagggcagcgcgaagcgttgccgaatagacctaggagcaatggattatgaagaggacgttccagccgaacaaccgtcgtcgccacatgaagcacggcttccgcctgcgcatgcgcacccgttctggccgtgcggtgatcaaccgtcgccgtgccaagggccgcaagaccctctccgcctgatcattccgatcagtgccacaggcatagtcgaggtggagaggcttcaaagccatcgtgatttcgtcaccgtgctgaaacgccggcgcaaagcaggtggcaaggatatcgtcgtgcactatttggtgcccgacgaccatcatgatgatgacgaccggacggtgcatcgccgtttgggattagctgtctccaaatcggtaggacatgcggtcacccgtaatacggtgaagcgtaggtttcgtgtattggccagagcccatgaggatctgctgcccgcgcattgcgatatcgttttgcgcgccaagcccagtgcagcgaccgcatcgttcgcttcgctagatcagcagatcgcgaaggcttttgccacggtggcgcataaggtggctgaggcatgacagcttctttcaaggcggtgatgattggtggggtgcgctggtatcaacagcacatctcggcaaacacaccgccttgttgcaagtattatccaacgtgctcgaattatgccattgaggcattggaacggtatggcgcgttcaaagggggagtgctcgccgtgctgagattactgcgttgccggccgtggagtcgtgggggaatcgacgatgttccacaacggtattccgttttttacaggttttcgtggtcgaaggctcatgaagagcctcgactgacaccattggccacaacccaaagagaggcccaacgatgaactcaaatgaatttctgcttgatagcgggttttggggatttctatataaaatcctgactcccgttgagtggttgcagacctggatcatgaagatcgtgcatgacttcttcgtgatgctgggcgtgagcccgattggtgtctcatgggtgcttgccattatcatcctggtgctggtggtgcaggcttgtatcttcccgctgttctacaagcagatgaagtcgatgcgcaagatgcaggcattggcgccgaagatgcagcgtattcagaacaagtacaaaggcaagacggatcaggcttccagggaggccatgagccgtgaaaccatgaaactgtatcaagacaatgacgtcaatccggctggctcctgcttgcctatgctcattcagggcccggtgttcatgtccatgttctatacgctgtcggccattccatacattgccaacggtaaacgcgatgcgttgggcgcgttcgacgtagcaaccgccaagcaattcacccaaaccgatgtgttcggcattgtcagcgtgaccgataacttcaccagtgctgccgctagtggcaaggcggtcatcggtatcttcgtgttcctgatgtgtttctgcctgtggtttatgcagtacttcagcatgaagcgcaacatggcagctgcttcgatgaacaagcagaccgagaccatgcagaaggctatgctgtggctcttcccggtgatgtacatcttctccggtgtcgccatgccgttcgccgtgctggtctactggctgaccaacaacgtgtgcaacctctgccgcacattgtggcaggtgtacgcattcccgacccctggctctccggctgcggcggacaaggagaagcgcgatcatcgtaatgagaatgctcgccgcgcaaaggccggcctgccctctctggaagaagaagcattggccaaggccaaggaagaggccgagcgtaaggccactcagggctatcagcgtcaacagcccgtgcgtaagcgcaaaaagaagtgacgactatgtcggtgcgagttcgatgtttcacgtgaaacattcaacacgcaccgacattactttctctgttcgggggagcagggcttagacttggaattcaaacacgacatgaaggagtagcgtatggcacaggatgacgtgaagtcgatcgaccagctcaacgaagaggctgacatcgccgcggattaccttgaaggcctactggatatcgccgactatgagggcgacattgagatgggcgtgcgtaatgaccgccccaccgtgcaaatcgttgctgatgacgatactgacatcaaacatcttattggccgtaatggtgaagtcgttgatgctctgcagcaattgactcgtctggctgtacagcagaagaccggcgagcgttctcatctgattgtggatgtcgacggtttcctgaagcgcaagcgtcagcacctccgtgatatcgccttggatgccattgacgcagtgaaggattccggcgagccgtatgacttgaagccgatgaattccttcgaacgtaaagtcgttcacgatgtggttcgggaagaggggctgaagtctcgctcgcacggtgaggagcctcatcgttacgtgacggtgtatctcaagaatagagtcgaggataccgccgaagacgacgagcttgatcaggagtaattgctcggcgagtttttttgagatgacagggacgttcgacggatgtcgtctttgaacaaactaaagtgaccgcatggagaatggcgtcgtaatgagcggcgccattctccatgttgattgtttcacgtgaaacatggtgagggagatggctatgacggatcagctgcaggggtcacctgtacttgctgaggtcttgggtgatgcgttgccgaagttggagcgtttccatgccaagattgccgaagagggtgaacctcgtggattgatcggcccccgtgacgtcgatatcatttgggaacggcatattctgaattccgctgcgattgtgccgtacgttcggaatgcgacgaatggtattcgcttcaaaacagttgccgacgtcggcagtggtggtggttttcctggattggtggctgccgcgtgtttgccggatcatgacttcacgctgattgaaccgatggagcggcgaatcgaatggttgcatgaatgtgttggcctgatgcaactgcagaacgttgagattattcgtggacgctccgatgccgtcatccagcaggtacggaagcgggaaattcatccgttcgctgttgtcacgtgtcgtgcggttgctcctatgaccaaactctctggctggacgttgccgttgctgaaaccgtcaggacagttgatcgcactgaagggacggtctgctcaggctgaaatcgacaaggctggcaaggagattgcaaaattcggtggtcgtcgtccacgcgtcgttgaggcggctgtcggaccggatcttgagcctacccacgtggtgattgtggataagcgatgagtggagtactgattgagttatccacatttccatatgtgcgtaaaagttatccacatttttacgggacgatgtgcagaatgatgaaaacactgatttttcaatgtttttcgtctgcgaatacataatctaacactcaacgtcattcacacttatccacacttatccacattgcatatcgcaattgtggataacgagcatcatgtccatacgaatgagaacactggaacttacgtctgtgcaaggaggagcgatggccaccaaggatcatcagtcggaacctatagaatcggcttccgaaacgcttcagcgaatattcgatggtcacggttcagtgcttggtagccaaatggctgatgaaagctcacgctacgatgtactcaagaaaaccgatttcccaaagcctcaacggactcgtcgtatcgccgtggccaaccagaaggggggagtgggtaaaaccacatccacggtaaacaccgctgcggcgctggcgaacaagggcgcgcaggtgttggtcatcgatatggacccgcagggcaatgcctctacggcgttgggtgtatctcatgcatcgggagagccctcggtctatgacgttatcgaggggcgttccgatctgggtgatgttatcacggtctgtcctgattttcccacacttgatgttgtgcctgcatcaatcgatctcagcggtgctgagttggaagtggctgatctgcccaaccgaaacacgttgctgaaggaggccctagacctctacctacgtcaatcagataaacactatgattacgtgttcattgattgcccgcccagcttgggcctcttggtcatcaacgccatgtgtgcagtgaccgagatgctgattcctatccaggctgagtattacgcattggagggtcttggccagctgattaacacgattggtttggtgcaagagcatttcaatcccgtactgctggtgtccaccatgctcgtcacgatgttcgatcgccgaacgttattgagccgtgaagtatataacgaggttaagggacactatcccagcattgtgctgaataccaccatcccgcgttcagtcaagatctccgaagcgccgagtttctcccaatcggtgattgcctatgatcctcgtggcataggtgccatatcgtatggtgaagcagctttggaaatcgcacagcgttcgcaacaagtccttgacaccattgatgcgaggaggaacaagtaatggcatcaaaatcacgacttggtaagggccttggcgctttgttccccacattgccaggggaggagccggtggcggagcagcccgcaatgattgcggaggattcgtctactccggaggccactgctgacataacccccgccaagaaggctactgcccagcaggaatcaaaacctgccgtgcctcagacgatatcgtccagcaaggcagtcaagaaagccgccggtaaacgcgcatccatgcccgcattggacaccattactcatcctagcgacctgtttttcggtacggagaaacctcaaaccggtaaggtcgccgcacctcagcagggcggcaagtcgtctgcgtctcagacggcacatcgtacatccgtcactgtcaaagatgtttcacgtgaaacatctttgactgcatcggcggcaaagaccgctgacacagataagaaggacgagctcaagccggtagccggtggttatctggctgaactcaaactgtctgatatcgggcccaatgcacatcagcctcgtaccatcttcgacgaggatgagttgaatgagctgtctgcttccattaaggaagttggtgtgctgcaaccgatagtcgtgcgcaagcgtccggcaagccagattgctgcggccaaagccgccaagcacgacgagacggaatccagcacgaatccgtttgccggtcatttggacagcccgtatgagctcattatgggtgaacgccgttggcgtgcttctcagttggctgggttggagacgattcccgccatcgtcaaaaccactgcggatgatgatatgctccgcgatgcattgctggaaaacttgcaccgtgtggccttgaatccgctggaagaggcggctgcctaccagcagatgattgaagagttcgggttgacacaagtacaactgtccaagtcggtgtccaagtctcgcccgcaaatcgccaataccttgcgactgctgaacctgccggcctctgtgcaaaagagagtggctgccggtgtgctatcgtccggtcatgcgcgtgcgctattgggcctgagcgatccggaggaaatggacaagctggcttctcgtattattgcggaaggtctttctgtacgcagcaccgaagaaatcgtcgccatgaagattgcgtcgggggagcagccgaagaagcctaagacgtctaagaccaatccttgggttggttccgccatccagcagagtttggaaaatcatttcgataccaaggtgtcgattaagggcagcaccaagcatggtcgcatcgaaatcgtcttctcgtcaccagaggatatggatcgtatcctgcagctgctggtgccgagccaaggcgatgccgattccaaatgggtgtaacgcgataagaacattcgtgttgtcgccggcattattgctgtgcagtgcgttgtatgcgcaagacgttatagcctctgcgtgattcctggtaggggcgtatgcccgcgctgtagcccctgtcgcaatagaaaacccctcaggctggagagacaatcacacatcgtgattctccgtcgcctgaggggtctttctatgcctttgaccgatacgtactatccaagggcggcatgctgtaacactgacctagcgttgctcctatgtcacaggcagcagccagaacagcaagccaccatcagtccgccaccatcagtccgtaagataggcctgcgcatccagcgctgcacggcagcccatgcccgctgcgctgatcgcctgacgataagtacgatccacgcaatcgcctgcagcaaagatgcctggcgcactggtcatcgtgctggcaccctgcaccacgacatatccatcatcgtcacggtccacaacaccggccgcaaaatcagtggctggcgtatggccgatagccacgaatacggcgttggtgtccagcgtgctttcttctccggtcaccacgttacgtacggcaatgctgctgacactggccggtgccacagccggtcgtttgattgtcaagccaggaatggcaacaggtgcaccggtgttctgtgtgggggaggaggtgccggtaatggaggtcaccactgtgttggtcagtagggtgatggtcggattggctttggctcggtccaccatgatctgcgaggcacggaagctatcgcgtcggtgaatcaaggtgaccgaagaaccgaaccgggtcaggaataatgcctcttcaaaagccgaatcgccaccgcctacgaccacgataggcttgttcctgaagaagaagccatcgcaggtggcgcagtacgagacgccatgtccggacagctcctgttcgccgggcaccccaagcttacggaatgacgaccctgtggcgatgatgagtgctgatgcctccaactgggagtcatcggagagcgttacacgataggtcggcttgaccgaatcactctcacacgcctcaatggaagagacatcgtctgtgatataggttgtaccgaagcgcttggcctgttccttcatgcgatccataagatccgggccaagaataccttccgggaatccggggaagttctccacctcagtggtgttgaccaactgtccacctggcgacaacgcaccagtgaccataacaggattaagacctgcacggccaagatagatggcggccgtgtagccagcgggaccagaaccgataatgatgacgttatgtttcacgtgaaacattgtcacacccccatacgatattccatgtcattcagccagacgcgaagaaagggcggcaccgtcgaatgtatgcgaacggtaccgcccttcttgggtcagttatcggtatagatgccgattagaagacctccaccttctcgatgtacagctggttctgcggcaggctacccgatggcacccacagcagcagatcctgcgtattgacggctttggtgaacttcacctcagtagtgccaccttcagcaaaggtgaattcggccacctgctcgccctgagtggggtctccagtggtatttgcgcgaatatagcccttaccaccggatgtgcggatggtgataaccatgcggtacgcatcctgcggctggtcaaggtgcatgtagtatgcgtacccggattggccgccaggattcgacaggaagttggcgctggaaatcgtaaacgccgtgttgttctcatggcgcggttgcggagcagcgctggaatccttatcgccggacttcttggccttggtcttcttggacgacgaatcagcagtctcggacttcttggacttgtctgatgctgagtccctggattcgctctgagtggcatcactcgactttgaggaatcgtcagtggcgccaccgttcgtcgcgttcttgctgccaccgaatggcacagcgtcagcattgatatcgggccagtcaccttcactggagttgctggaagcatcggcaggattgtctccggaggatcggaacgcatgcactgcccaaacagccgctgccactaccaatatcagagccacaatgatggcaacgaccttggtcgacagtttgccgaacagatgttcatcgggcagcttgctgtcatcctcgtcatccggcacatccttcggtgtgaagctcggaggaatggcgcttacttcggcaatgcgggcctgctcctcttccaaggcacgcagcgattcctcaccgggggccacagcacggccgctgacatcgaacacgggaatacgactggtcgtctctcccacggtggcatcggaaataccgccggtaacaataggcaccgtcaaccgagtattatcacccggaccgccgatgggggccggattcatttcgctgtaccagtcaccggtgtcttcaccggaaagattctcgtgctcccaggcgtcagaaaggttgaagtcaaacagacggcgggcgtcagattgagactggttgccgtcagcagtactggacccatcaggcagaggagccggtgacatcgcgtgcggagcggggacggcggccggctgaaccggcagggaaggggtaatagacaattccggaagactgctgctgttaatcaacgtgctgggaataggcacgatatcggtctcgttggcgggcttcagtatcgccttggtaatcgagcaatcgctttccatgctcggcaaagcgatatcagcatcgctcagttcagagagctgcttccaattacccaacaaggcgtcgagttctacaagggcagccatcggcaacgtgtgctcgtcgggcttgcttaaggccaatccacgcttgcaaatcacgcggaattcgccaggggtgtcttgcggcaaggcgcgcagattgaatgtgggtgtcgcttggcttggcgtgcgtgtcagcagggcatagagcaatgccgcaagctggcgaatcgcataccgttcaggaccgtccgtacgcagatcggtagcggacgtgtcggccagcatcgtggcacatggtgcatcggcaatctgcacaccggaggtagtcactcgaacggtgtcggttgtgatgacgatgccgctgggagtatccgcaatgacctcgcgcagcacgtcggcgcattctccgataatcgaccggatggcgctgtagctgagcggcttgtcggtatctaccatgtagtcagtcaggcattggccgctgtccaccggcatgacaatgagaagtacgtcggattccatacggtatttcagtacgggaatcacacgatcagggcgagtggcggcgatgcgaccagcgagctcatcgattgcggcgaaagcgctgcgattggtaatgatgaacagctggcaatcctttgccaacacacggtcgttggctttccatgcctgaatgccaggctcctcacgcaacgacgataccaaggtgtatcggttgagaatcgtgtctccgagttgcggtttcatagtgcgttcggctccgtgtgattggtgttcgagactggtcttagatattctacgtgtggggctatccttgacgggctccgtctcaggattgatttgcgtatcgtcgactttttccggctgggctgtcacagcaacgtcctcactggccggagtcttgtgtagacgggccagtatcgagtgataggcgctgatgagttccggggtgcgtatcacccacaacacagccacatatactacggccagcacgatggtgagcaccacgcagatggccagcgcagaccaccagctcatgtgcccgcctactggtcgaatatccgcgtcgaacagtgcgactaccggtcgtttgatcagccagaccacaactccggaagccagcgccgccacaatggccttggcatatgtcctcgtgatctcccgaccgccaagattgccttcgaacttgcggcgcaacatcatcaacgtcagcggcaacgccagtaatccgccgagtgtcaccgagcaggcgatgccgagtacccaatgctcaggaggaagtaccatcatgccgatgatcatgaataccgaggtgaacccatactgcatcaccgcggataggaaggggtgaaggccgtcctcaaaggcgtagaacgtgcgctggatcaacaggaacgccgaccccaatggaatgcccatagacaaggcgataagcgcataggagatcaacatagtctcgtccatcgagacggacggaagcaatgcacggatgatcggttcggggaacacgaccatggcggcggcgaagaacatgatcagcagccctacgttgttcagcgcgctcaccagatcgtgccgtgcctcatccagattcgcagctgcgatggaacgggagatcttggggaacatagccgtggataccgatacggcgatgagcgaatagggcaggatgaacagtgtgtacgcattctgataggtcgcgttgcctgccacgctgaacaggctggcacccgtcagttcgtgggcgcgctgcggtgcggatgtggcgatacgggtaaggataatgccgcagatctcactggtgaccaccacgcccaaagagcctaacgccacgggacccatagacctgagtccaaagccgccaagcccgaagctgggtttgtacttgaacccgatacgggccagcggcaggaacagtatcagcgcttggaaggccacgcccaaagtccaggtgcctgcggtaagcgcgattttgtcggcggtccagaattcgaggggctgttcattggccttgctgaacagcagaataaagccagtaaaaccggcgcaactaataatgttggcaccggttgagctccacgcatacgtgaggaaatggtctttggcggccaggatctgacccaataccgtatacaggccgtagaagaacacctgaggcatgcaccacagggtgaacgaggtggtcagggctatcatctggtgatcgtcgctacccacgtacaggcgggcaagcagagggctggccgccgccatcaccacggtcatggccaataggatgccgatggccaacgtaatcaggcgattcagtcgttcttgggcgtctttttctttcaacgtgcgcacgatctggggcaccagcacggcgttgaagatgccgccggacaccagcgtgaacacggattggggaatcatggaaccggcctgataggcgttggccgccaatccggtggtgccgatggccgcagcgagaagaatcgtgcggagctgaccggtcacacgggaagcagcggttcccgtggccatgatcagggaattacgacctacgcttgaactcattcgtcggggtccttcttccgatggaactgccgccacaggccgataatgcccagtagcacggcgaagccgatgataatgaagccgctggcatcactgatgcgcatcacactggtgatcgcggtgtcctgcgtgttgccgaagctgttgccttcccggtcggtcaacgacacatgggccgtcgatgagccggaagtggaaacgcggatggtgaaggtcacctgagcgtcgctatgcgagggaatatcgatgtcagcggttcgcgaggtgacgatctgcatggagtcagtcagtgagttgacctgcacgctgacggcgtagggaaggtcattgctgacggtgattggcattttcgcggattcgctgaacacggatattgattccgatgggttgatgcgtacgccgttcagaagatcgctggccagtgttttcgcggctttgaccatggcttttcgcgtggctgtcggctggggggagccagacatggaccgcagcgccatatcgtcatgcagcaccagtaaagagccaatccattgcgtcggatcgttgctatgcgaggcggtgtcattggcgtcctgccgggccagggcctgcgggtccaacgacgagacttcgtcggaatcaatctcgttcctcaatatggaggtggccatgcgcatgatgtcatgccggctgtcggccaactgtctcaatgccgaccgggtattggcggtgttggcatcatcggccttgtcgggattgaccgaatcgctgacattgtacggatcggccttggccatggtcttcaggtccgtcagattcaaccaagacgcctgctcgaaggcgctcatcacctgatcgatccagctggcctccgtggtgcgggagaacgtcataagcaggtatcgggatgtatagggctgttccatctggtagaacgcgctctgagcgatcagtcgggccaaccgaccggcatcgctggactcggcctgcgcgtccgtgctggtggcttggcccttggccagcgtgcccaaggtcgattgctccttcagcacggtgacatcgccggcaggcgtatgcaccacgtaggtgcctgtgtgtacggcttcagtctggtcggcatcgaaagaggcatcggcaatcaccgtgtcatagccctgctcgcgtgctgcggtcagcgcatccaacgtccaacagttgttgccctgccatgcgtacgcggagggtgtttcggagtcgtctccgtcggcataccatgcggccgcctgcttggcgttccactgctcagtggtgatgccggccttttcgtaggccgcggtatcacccagcgcggtataggcggtgatgtcgaagtcggcgggctgcatgatgccggcaatggacggttgcactgcggactgacgccaatacagaggatccgcgatcacttgcagcgagcggtgcttggcgaatgtctgcccaagggatcgcgcggtatcggcatcctgctcggataaggatatggcttgcgtatcagtggctttggccgcgttgctggcgtcggcgttatcggacttgtcggccttgtctgtgctgttggacttggacgatgttgatgtcgaggaagtggtggtttcggcaatgcgattgctgatggccttattatcgacctgccagccgctggcggtgtagggcatggccacggtcaggttcatggccggtgttgtcgcggtgttgagcccatccgaagatcgggtcagaaaactcggcaaatcggcgagtatctgattgccaacgatatacgacagcatcagcggtttcggtccccaactccctatggaggcaagggtctgctgattggcgttcacctcgacggtgacggtggcagtgccgccggcgggaatcgatggcacgtcaacggaacccaactcgttgggggtggggatgggggcgttgttctcggcccaattctgaatatcggtgcgcgagacaaaggtgaacaacgcattggtggtcaggtgcagtgtgccgcttgacgtggccgtgctgtccgtattgctgatgaccgcggtgacacgatagcccgatttggaggtgacgatgggggtgctttgcgtgatggcaatgctctgcttgggctgattctcggtctgattgcccgttgcgtccgtcgtatcggatgatgaatcagtcgtgtccgtcgtatcgttcgcgtaggcggtcaatggagcggccagcatcgccacaacggcgacgccagccgccagtgcgtgtgccagacgtgtgtaatgtcgtaagactccgggtaggttcactcgtttgcctgcctgttcttcttcctggcgtagagccacgcgattttgcgttcgttgggatagctcaacacgccatccaaatcttcaaaacgtacccagatggcgtcttccgcctcatgatccgggtctccttccaccgtcaattcgccgccggtctgtttgagcgcgaagtgatggaccagcttatgcacgcgctgcgtggtaccggtgaaccagtagtcgatggtggcgatggaatcgatcacctcgcccaggatgccggtctcttcatgcacttcgcgcacagcggtctgctgcggggtctcgcctttttcgatatgccccttcggcaagcaccattcgagatggccggagcgggaatgacgggcgataatggccacgcggttctggtcatcgaaaatcagaccgcctgccgaatattcgcgtacgaccggcagttcctgggcatccagtgaagcgaatgtggtcggaccgtccgacgtacggcgttgcggcatcatggccggagtcgggccggatggcgtcaccggttctaccggcactgccggttccggcgaggcaacatctccggacgggtgccggccgaagaccgtggccggcgtgggatgcgctgacgttgcgggcctcactggtgctgcagacggcgctgagaccggcatggtgaccggcgttgcggccggtgcggtacgtgccgcaggcggcatcagcacgtcgcgcggagtcggtatcgctgtggtgtgcgcggcggccttggcgaccgcaacggcagcatctacggccgcgtgagcggtcgccgcgggatcgttcgtgacgatggttacggacgtttgtgccgtggcgataatcggctcgacctcggcaatcgtctcggcaccggcctcgccggcgataccatcagcctgcccctcgatagtgccgctggtagtggcgatggtgacggtggcatgcatgccgaagacggtggccggtgtgggcatcatcggcttcggtgcgggcatgtcgctggcggcgtccgatatttcggattcggatggtgcgggtgtggcgggcgttgcgggtgtgccgggtacaccggaatgttgcgcagtcggtactgcgtctacttcgtcttgatgaacggcctgattggtggagtggctcgcggtgccgccggcatcgggagaatcgcccgaatcggcggaatgatgcggagtttcggacgtatacagcaggtggtcttgggtatggctatccgccgaatctggtgtttgccccagcatgcgggcaaggtcggcgggcgtaatcatattctccaccttactcaaccccgtgtgcaggtggggtaacggtatgctggtagggcagaaaaacgtcgcacgcgggaaggtgcccattggatttcgaagtatggcctgaagccatcgaacttggtcgactgttcgccgaacagggttacgagctggcattggtcggcggcccggtcagggatttgctgctccatagaaagagccacgatttggacttctgctcatccgcacggcctgagcagttcgagccgatactgcgccggtgggggcatgacggcttctgggacatggggcgcaagttcggcacgctgggtgccatgcgccgccgcccggacggcaccgaggtcaaggtggaggtcaccacctatcgctctgacacgtacgatccggactcgcgtaagcccgaggtcaattatggcgacacgcttgagggcgacctgtcccgccgcgacttcaccgtcaacgcgatggctctgcgcgtgcccgacctgcaattcgtggacccgttcggtggtgccagtgatctgtccaagggcgtgttgcgcacgccggtggacccgcgacagtcctttgacgacgatccgttgcgtatgatgcgcgccgtgcgattcgtggcccagctgggcttccgtatcgcgccggacgcggccgaggcgattacctcgatgcgcgaccgcatcgacatcgtatccgccgagcgcgtgcgcgacgaactgaccaagctgctgctctccgaccgtccgcgcgccggccttgaggcgttggtcgaatccggtcttgcggacatcgtcttcccggagattccggccctgcaattgcagatcgacgaacaccaccgccacaaggacgtcttcgagcacacgatgattgtgctcgaacgcgcgatcgccctggaaaccggcccggacggcccggtgcccgcccccgacctgacgctgcgcttggccgccgtgatgcacgatatcggcaagccgaagacccgacggttcgagccgggcggcaaagtgagcttccaccaccatgacgcggtgggtgccaaaatgacccgcaagcgtttgaaggcgctgcgttttgaccaccatctggtcgaggacgtctcggaactggtgaatatgcacctgcgcttccacggctatgtggacgagccgtggaccgactcggccgtacgccggtatgtcaaggatgccgggcacctgtacgagcggctgaacaggctcacgcgcgcggacgccaccacacaaaacaagcgcaaggcgatgatcttctcccaggccatggatgagatggaggagcgcgtccgcgaactcaagaagaaagaggacttcgacgcgatccgcccggatctggacggcaacgaaattatggagttgctgggcctggagcccggcccgatgatcggccgcgcctacaagcacatgctggaataccgcttggataacggtccggtggaccacgatgtggccgtcgaagaactcaagcgctggtactccgagattcagtagtccgatagtagtccgataccaaaaaaccgtacgctgaatacgtgtcagcgtacggtttttcgcgaagatgaagctgtatgcgccttactgcgccgtgtatgcgtcgtgtttggtgtcggcgggcagcttggtcatgctatcggcggccttgcaaccctcgatattggtgatggtcttaccggattgtggggaggatttggtgtcctgcagatcgttgaacgtggcgccgatgaccacatcgatgagttgatcctcgcgagccgtcatgatcatggtggcgtcggtgaaattgccgatcagcgtatacgcctgattaatggcgttcttgccgaagtagatggtggtgcgttcaacgccggtgctggaatagttatcgattttctgcacgctgaatccacgattggccaaagcctcacccacggccttggcgaattggccgtgagaggtgccgttcatcacgcggatgccgaccgaagcgttggacacgtattgcgctttgccgctgctgtccttgaccgcgcacggtgccgcgttgccgtaattcggctggcgggccggagtctccacttcgccgaggccgaaaacgtggaaattgaacagtagggctatgaccagcactactgccaataccgcgccgctgatggaaaagacgatggtctggcggtggcgcacgtacgccttgcgggcttcacgttcatcaacctgatacgtcatcggtggacttctttcatgggtcgggtggctggttgctaccttagcgtcactgtctgacgccgatattggggtgtgcgggagatttggctcgaataatgcgatcgaccacagccgtatcgcgccacacatcgataatgcgttgtgccgctgcctcgtcggcggcgaaagcgaccactgaggggccggatccggagacgaatgcatggctggcacccgcctgcgtggcggcgtcgatggcctgcccgctgcggggatgcaggctgattgccgcagcctgcagatgattgcggtcgccttctgcggctcccacgaggtcaaaggtgtggtagacctcaggagtgctgagttgcgactggtacgcgccgaccaatacttcgccgctgaatccctgttctatcagcgccagctcatcgcggctgccggggatgatatccgtgatgcgttcgccgaaaccggtgccgtatgcaaggccaccggtcaggcagaacggcatgtccgcgcccaacgtggcagcaatggtgcgcaggcgctctatgggccagttcagctcccagagacgattgaccgccagcatggtcgccgcggcgtcggctgaaccgccgcctagtccggcacccacgggaatgcgcttggtgatggtcaacgccacatccggctcgcgctcggccgcctgggccatggcgaagagggccagtaccgcatggttgcggcgcatgtcgctgcgtgaggaggccaagtcgcccaaataagcgccttcgagctccagagagaatcctgctccgggttgcttggcggttgcggtgacggtgtcgtatacgccgattgcgcagtagatggtgtccagttcgtggcgtccgccccattcgtcgtgagcaggtcccacttccaaggtgagattggttttcgccgggcaatccaccgtaatggtgatgggggagagctcatcggactgatgtcgggcagcggctgagcgtggatgtgagattaccggactcattgtgcctcatctccatctccacacgattcgatggccttggccagagcggtgaattcggcgatggtgagcgtctctcctcgacgggtcggatcgatgccggcgatggagaatgcctcggagggcgcaatggtcttcaatgccgcgtgcagggtcttgcgacgctgaccgaatgccgcatcgatcagacgaaatacgagttcccgttgtgtgccgtcgtctgtgctgttcgcagttcccggggcagccgggtcatcggcctgataccgggtgaatttgacgagcgcggaatccacattgggagccggccagaacacattgcggccgatggtgcccacccgttcggcggtgccataccaggcgagcttcacgctcggcgtgccgtagatcttggaaccgggcttggcggcgagtctgtcggccacctctttttgcaccatcaccaagaacgagccgaggttgtcgaaacgctccaacagcgtgagcagaatcggcgtggccacgttgtacggcagattggcgaccagcgtaaacgatgcgtcatcgctgaaatcaggcacgttctccggggtgacggttaaggcatcccgattgacgacggtgagtcgtgacgtggcttcgggcatgaattcggcgactgtgcccggcagtcgttcggccagcggcggatcgatttcgactgcggtcatggtggcgccggtttccaaaatcgccagcgtcaacgatcccaggccggggccgacttccatgacatgatcggcagcggtcactcccgcctcgcgtacgatacgacggaccgtgccggggtcgatgacgaagttctgcccgaatttcttggtggggctgatgccggcatcggccgcgatacgacggatatcggcggcacctaacaggtgaccagtggcgggaatggtgtcgttcataagcgtgtgttccttgtgggcttcgtaaccgatcagtaccaaccgacttgttcggaatgttgccatgccttggacgggctgccgtaggcttgtgcgatgtaccacagaccccaatcgatctgtacggcggcatcgtcacggtaattggcaccgaacgcagccattttgtctgctggtagcgactgaggaatgccgtaggcaccggagctcgcgttttcggcataccacagccaactggactcgcgggtccatagtttgaccagacaatcccagtcgttgcctgtccacccgcgctgcgcggcggcaccggcggcataggcctgagcctgggctacggtggcgtgccacaggcggccggagggcgtggtggttgtgcctgaatcggagccagaagagccggaattgttgttcgtaccgccgccggtgttaccagtgttgccggagttgccggtgttaccggtgttgccagtgttaccggaattgccggtgttgccggagttgttgccgccggtgttgccggaattgccggtgttgccggagttgttgccgccggtgttgccggcattgttgttggacgactcgtgctgattgttggaaccggaatcggccttgccgttatcggcggagtcggatttcttatcggaacctttatcggtatcagacttggcggcgcctacggcgatgatctggtcgatggccatcgaggtgacggtctccgatttcagcgtctccgattcggccacgccatccacataggtgacgtcgtacacctgcgtcttctcgccgttgacgccctgctggcgcacatcggcctgcccttcagccagattcgggtcgatgatggtctgggtggagaacggaatcacggacgtgcgcgtcttctcgccgtgggtcacgcggcgtacgcgcagaatggtctcgtcgctgtctttctcaacgctgacgcgatcctccttgttgagcacaatgcccttggaatcgaggatggaggcggccggcagcttgccattgggggccaccgagcttttgccgtcggcgatgacggtgaccggcccggactggttgatcaccaggccgccggtgagctggttgtacacgttcttgatgtcgacggtgatcttcgcggcgttgttctggttttcctcgaaaaatcccagcaactggtcggcgctggtggccacggtccagaacggcacggcggtgccgtcgatgttgatagtggtctggtaggcggactgtacggtgaccacggcatgattggcgagttggtcgccggacgaggtagtgacgatatcgtgggtcttgatatccaccccttgttcctccagaagacgggtggccgtcatcgcatatgtggtgacttgggtggtttgcccgttgatgttcagggctacggatttacgcgcggtgaacgcgaatgatccagccagcgcgatactggtcgccgcgatacaggcgattacgcggatgcgacgcagtgtaacaaaccgctgcggggtccaacgccgtgccattgccatactcttcctgctggatgaacgattacgccacccatcgtaacggttgctccggcccgtactgcggtttcaccggccaccgtcaccattcctgctcgtcagattgttctgagctcaaaaaaagaaaagaaaaagggggcgggagagaaggggatgttcccgccccccctgaaggcgcggagctggttgggggacgctccgccctcattccaggaagcccatagttgggggaaggctcctggagtacttacccaaggtaagaattatatgcgtagaaaagtctacgtatcacataatacgccattttttctgcgcgacgagcctcttgtcgggatcgaaccgacgacctgccgcttacaaggcggccgctctggccatctgagctaaagaggcgattgttcttaacgcgtaaatcgttgcgaacaaatgactagtataccggtacttcccgagtggtcaatttaagccgagccgcaggcggtattgcatatgtcgcggcgtcaacttattcggccacgcagcatcaggaggcgaccgaaatcggctttccgctggcaccgatggatggcattttgccttccacgcctacctggtcagcatccagcccaatggacttgaggaagccgtccaccatattcgtgtccgccagcgtgagctgcttcagatcccagtattcgccgttgatggtgagtgtgggggaggagaaggcgccggagctgttgaacagttcggggcgcaggatcgtgtagttgttggaggcggtgagccagtcgaggtattcgttcttgccgctgaacgccgcggcggccacatcctcgctcacgccggccttgacggcctgcttctccagcttggcgttgtttaccggctcgtaattggacaattcgcccggctggaaatcctcagcgtagatgttggagaggtagctcatgaggtggtcgggatcgtcatcatgctcggcaatgtagatggcaccgttgaacacgcggttggagtagttgtcggagctcttgttgttctggaaattgaggaagtgcaaatcgatgttgagctggcctgcgttcatcagcttgacgagcgtcgggtcgagttggcggttcaccgaggcgcagccggggcacagcggttccatgtagatggatacggtgggagccccctcggctttctggccataccctttgttggagattacgaagccggccttgtcgtcggcgttagccggctgggtactgactttcttgagcttgctataggcctcgtccacggtcatgttgctttgctggctactgctgctggtgttggacggccgcatagccttgtatacggcgaatccagcgatggccaccagcaccacaataatggccaccacaatgcagccgatgatggtctgctgcttacgctccttggctgcctgctcggcccgtgcctgttgtgcggcctcctcggccgctcggcgctcagcgcgtgtggcacgcttggcctgacgcttcggatctgacatagctatccccttgcaatcgcttcaatgtttgggccccatcataatgaccgggcctgaggaggactgcgcccagagctgatctgaggtgaattccctgtaaaagtgtgacggaacgaacgtatcggatacacaacggccatgtgtgcggatggctgatgtgtgagattccgccccgctctaggcgaacggcatccagttgatcggcatgcccagaatcggcatcgcgcacaaggccacggtgatgatggcccatatggtgaacagcacggtgccgcgcccgccgcccttgggcgccggcgccactggagcaggtggagccccacccacttcggtggatggcgcgcccgccgggcgactgtgtttgagcccgcgcagtacgccgccccccagccgaatcatcatcgactgtggggcgaacacagtgaccagccagccgatggccatgaaaccgcccagcgccagcccggaagcggagaacggcacatcattgagcaacggcaccggaataccccaatccgcggtgaaataccaggagatggtgtgaacgggcagtgccagagccgcggtggccacggcggttcccgccatatagatgatgactagcagcagtatgcggggaatggccagcagcagggctttgaccagatgccagggaaaagtcgccacgcgaatccacgaatcggagtttttgcgctcgccgccgcgtttgccctcgcgctcaagctggggttcggtgttataggccagggtgagcagtagccacaacaacgcggtggccgcgatgatggccacgagcggagcatttgccgccagtgccgccagcggcgccgccagcaggatcaatggcagggtgccgcgctgcagatattcccctcgcttcacgtccaccggattgggcatgggaggattttggaccatggtttcggtgggggccgcttgggcggtttggtcgatgatgcgctgcaatgccgggcgaatggcggggtccaccgctgtgggctggttgcttgcgggatcccagctgctctgggcggtgccggacggggggaatgatgacggctgcggcgtggggagtacggtggtgcgctcggccagcggcgtggcctgctccgcaccggccggcggacgtggcggcatatcggctaagggcagcgtggcggtagcggcgccagccggcgagaatacggcggtttcgccatcgccgttatcgcccttattgccggagaacacggccatggtgggagcctcagcggcttcctcggccgcgcgccagatggttcggggattattgcggtcaacgccgccggccgcgccaaaagggggcatcgcctccgcggcttcggcaacgatcgcagccggttgcccagccacggctcccgcggcgaacggtcccgcctgctcgccctgccaagcgttgggattcaacgcatccaaggcgatggcattcagcaattgatccggcgtgcaacgatccctgcgatccgggtccagtgcagaacggaaggcagccaatgtgccggccggtagtccggaaagattcgcgttgcccgaggcctcgcgctcaagtaccgccatcatcggcttggtgccgaacacaggcgcgccggttgcggcaaaagcgagcacggacgccaccgaccaccaatcggtggcgtcgtcggattcggcaccgtcaataatctcgggtgcgatgaatccgggtgtacccatcactaggccggtgcgggtcacgtgactttcgccctcgcccatcgcgataccgaaatcgaccaataccggtccggcggccgacaccatcacattggtgggtttgatgtcgcgatggacgatgccggccgcatgtacggctttggtggcttcgatgagcttgcgggccaagcgttccagatcgtcgcccacataccggccattggcggccacatcatccttaagattcttgccctcgatgagttcagtgacgatgaacgccaacgtatcgtcgagttccatatccacgatgccgcacacacccggatgattgaccttcttcaaggccatggcctcgcgccgcaggcgctcgcgcggcgtgacatcgggcttgaggtcggggtcgtgcagggccgtggacgcagagccggagcctgccactgactcgtcggtcagggagtcgcgcagaatcttcatggcataggtggtgccgccgtcgtcgcgcacccgccacaccgaccccatagctcctgagccgagccgggagatcagcgtatacccaccaaccacttcgccgggctcaagattcaacgcgttcaaatcgctcatgccctccatcctaatgccttgccggtgcattattctggctctctcctgggaggccgagcttgatatttcttggctcccctctctgagaggggagccaaggataaatgccgtttacgtattgagaagtgccgtttacgtattgagaagtgccgtttacgccattaaggtcgattgccctgaccggatgtggtagcaaattatgcgctcgaaatgacaggataggtgcgtgggcaggtgcgccagtcgtgaatttgcgactctataaccatcggcatcaaggatgtgtcggcggtgacccaaaggtgagccagccgggcacattcaacagtggcacagcgatgcaagggcagtatcgtgagccgctgatcgaatcgataacgatatcagattcgaatgccgcgacttcgccggtcgtaccttcgaatacttctccgaagacggctacctgttcggcgtgatggcctcccagcaggtcgctggcgctccggtcaaggcctgaggtgtgtctccgataactgaatagctaaatagaatggacggcctgctgagtgctactcaacaggccgtccattgtgtatctgaatgcgaaaagtcattatatggaacggaatatatcgatactgtgcattgtgccgattactgattccgacgcaagtattcgcgcaggaagggcacggcaaaatcgacttcgcctcgttctgtttcgcggataacgaaggcgtcaaggaggcgtttgcggtaggtggcggcatagttaggcgttttgcccatgcgctgtgcaacattcacggtgggagagggaccatctgacgctgccatggcttcgagatactcacggtcgtttttggataagccttgcaactccgggatgcacacggcgttatcaaggtcaatacgtgcttcctcgatacctgccgtaacatcagcgtcgatgatggtatccgagtcccgcatgtctgcggcatcccagatatggtagccaaccagttgaatcatataggggtatccggctgtcacattggctgcagtgcttaattgagcgtcggtgatggacatgccggaggcgcggaatgttgtggcgaaagcatcgcgcacttcatcaagaggaatatctgtgagtatgttcgttttcgcgcgacgtaggaacgtgatgacttcgtcattgaacaaatcagaaatcatctgtgggagaccggcgaacacgatggcgatattgcgtcgttccctgatttgatgctgtatggcagtggcgatggcaatcatgtcggatcgctcagccgcttgagtctcatcaatggtgataagcaacccagcatggcgcttctcaagcgcatccaaccgtccggcaatggcacttctcaacgtttcgggcatacgcttcggggatagttcggcttctccgaggccgatgcccgctccagcaaaagtcaacgatggtcggatagtgaggtggtcaagggcccctcgcccggttcgtaaggcatcaacaaggcgttcgcatagtccggcagaggccgtttcttcgatgacatcccatctgcgcgctttggcccggtctccgaacacagtgagcatcacggtttttccggttccacgagcgccggtgacgagcataatgcgccctggggcaccgactccgttatcgagacctttctcgaaatcgcggataactttgcctcggccgatgagcaggggcggttcccctcctgccgttggcttgaatgggttttcctttgccttcatgtggaccgcctcctcgctgaatcaacctaaaataaaaattatcaaaaatatcaaaaaaataaaaattatcaaaagctgggttgagccgactgaagaaaacagccgtggcgacaatgatcctgccgcaatccgcggtgacaacaactgacgcggaccttcttggcagaatcgttgtttgtcccgcttcgccaatcaacgtcgctcaagttcggtgcgcagaccggctaccgtagcggtcagctcacgcacttcctcgcgcaataggtcgatttcgggattggctgatgtcgcaatagcctcttgcgcggcttccttggccacttccttctcccgagcgtcctcgcgccgatccgtctccagattgacctgatccacgatccacgaggccagcgtggccgtcacaataccgatcaacgcgatgccggtgaacatcagcaccaccgcaatgatcttgccttggaaggtgaccggcgagaagtcgccatatcccacggtggtcacggtcacgaacgcccaccacaacgccgtgccgaagtcggtgatcgtggatccggacgcctcgcgctccacggaatacacggccagcgcgcccacgtacatgagcattcccaccgcgccgaccgcgtatacggtgatgcgcccgcgcaccgccatgccggaggtgcggttcagcacgtgcagcacggtcagcaaacgcaacagtcgcaagggccggagcatcggcagcgcgatggtcagcagcgtgaacaggttgtgcttgaaccaccgccagcgatcgtcggccaaccacagcgagaccacataatcgacgacgaacaccacccagatcacgttgatgacggtttcacacagcgcgatatgcgtgcgggagagaatttcccacgaatacaccaccagaaacaccacggacagcaccatcagcggccagtccgtccacttcttccacgtcttcagtcccatattccgattgtagtggcgcgcccgctgcgccactgcggagcatgactccggacgtcagtgttgtatacgttcgtatacatttcacgttgtgtacgaacgtatacagcggtatctttcatctcgcatttcccttatgactatcaccacagtgatataatcaagaatatgtaaggagagagagaaggagccggccaatggagaccgcatcgatcgaactgtggcatggctcttcgcatgtcatcaagcatcctgaatacgggctggtcaagccgaacaacgattatggccgcggattctattgcacgcgcagcgtcgagctggccaaggaatgggcgtgcgcgggactggatgacggtttcgcgaatcggtacacgttgaccacggacgggctcctcttcctggacctgtcccagccgccctacaccatcctgaactggctggccatgctggtcgaaaaccgtcgtttccagccgaccaccgccgtcgccgcgcaaggcatcgaatatctgaaacaagtgtttctgccggatgccagtcaggctgacgtcatcgtcggatatcgtgccgacgattcgtatttctcgttcgcccgcgcttttgtcaataacgcgatttccatcgaccaactcgctgaggcgatgcggttgggcgagctcggcaagcagatcgtactcgccagtcctcaggcattcgcggcactgcggttccaaggctgcgaaatcgcccgcgcttcgacctaccacgtattgcgcaacgagcgcgaccgcacggctcgtgaagcctaccgtcgcaacagcgctgaagccgatctcgacggcctgttcatgcgcgacatcatccgtgagaaagtgaccaacgatgatcaccgcctacgatgagacatacttgccggacgccatggccaacttggccggcgccttcgattatgcgctgaacgattgcgggttgccggtcggcctattcatggacttcttcgccacctccgaggcggccgcgcttttcgggcgaggcacgcctaaatacgtgtgtggcatgtccggcgaggagctggtggccgaaatcatgcggcaaaccggttgggcgcgcattctcgatatgccgccagccgcactgcgcgccggctcaacacccgaatactgggccggatgggtactcgcatactgccaatggaccaggggagtgcggttctcggacattctcgatgtgctgtcgctcgacgatatcgtgcgactgcacccgactctgcacgaagccgacgaaagccgattcgtcgacgtgtacgacgagcgggccgcccataatcgcaccgagggcgactcccggctgcacacgatccgcgtgcgcgccggactcagccaatccgggctggcccgccgctccggcgttaccctgcgctccatccaaatgtacgagcagcgccgcaaagaccttggcaaagctgccgtctccaccgtgctcgctttggcccgcacgcttggctgccgcatcgaagatctgttggagccgtaaagacgcggagtagtatcgcgccgcatcgattctgataactgaacaactacttttaaggcccggccggatgctcgtttggacatccggccgggccttctggctccacacggggtgccgaggtatccgttctccgcttcgaggggctgatttggccttccgtagaggtttactcccgtttcgaggggctggtggcccgctagaacacgggtataaacggcttcgccccaccgtcattccgccattttggggatgcgcttacttgagtaccagcccctcgaaacggagatagatctccggaaagggtcaaaacagcccctcgaaactcaagatggcggttgcagggcggttgaggatcagtcgaagagcggttcaaacgcaaatgtgaacaatgccacatgtgattgggcgggtcgctgcacgccgattttcgggggtgcatgggaatggcggaatatcaatgaaaaaccctatatctaggtttgttatgtgacacgcgccactacatatagtgccttgatttcaaatcacaccgctgtaatatggccttcgcttcactgttcatcagaaccacatcaaggggagtcgccatgaccgtcaccgtgttcaccaagccgcattgcccgcagtgcgatgccaccaagcgccagctcaccaagctgggtgtgccgtttgaaaccgtggacctgacgcagaacccctccacccttgagcagctgcaggccgccggtttccagcaggctccggtggtcatcacgccggacaactcctggaccggctaccgccccgacctgattcgcgaagtcgcccagcaggtggccgccgacaaccgcgccgccgccacggtgtccgcgtgagtctgagccagcccgaattcgcggccgaaggcaagacgatcggcgcattggtctacttctcgtcggcctccgaaaacaccgcacggttcgtggccggatgccgtttgcaggacgaaggcatcaacgtctaccgcatcccgttgcgggccgccgacccggcgctaaacgtccgcgaaccgtacgtcatcatggtgcccacctatggcggcggcgtggtcaagaaagcagtgccgattcaggtcaaacgcttcctcaacgatccagccaaccgcgagtggattcgcggcgtcatcgcctcaggcaacaccaatttcggtgaggcctactgtgccgccggagacatcatcgccgccaaatgcaaggtgccctacctctaccgttacgaactcatgggcaccccggaagacactgccgccgtgcgaaacggcctcgtccgcttcttcaccgaacagtaaatcttgaccccctcgaggtattggctcccctctccgaggggagctgtcaacgaagttgactgggggagcaactgtctgagtaaacacacttctgccatattccaaggatttccaatgactgacctcaccgccaccggcctgccgctcgacaatactgccgacaccgcagcggaacagtacgacccggcgcacgattaccacgcgctcaacgcgatgctcaacctctatgacgccgacggcaagatccagttcgacaaagacaaggccgccgaacgcgaatacgtgacagggcacgtggccaccaacagcaagcggttcgcctccaccgccgagcgtctcgaatacctgatcagcaaccagtactacaaccctgcggtcttcaaccagtactccgctgaattcctcgaccgcatctacgagcacgtggaatccgccggctttgagttcggcactttccttggtgcgttcaagttctacacgtcctacgcgctcaagacgttcgatggtcgcctctatcttgaggacttcccgcagcgttgcgccgctgtggccctggagctcgccgccggcaatgagcagcaggccatcgaatacgccgacgaaatgcttgccggccgcttccagcccgccaccccgaccttcctgaacctcggcaaggcccagcgtggcgaaccggtcagctgcttcctggtgcgcatcgaagacaacatggagtcgatttcgcgcggcatcaacgcggccctccagctctccaagcgcggcggtggcgtggccctgctgctgagcaacctgcgcgagctcggcgccccgatcaagcacatcgagaaccagtccagcggcgtgattccggtcatgaagctgctggaggactccttctcctatgccaaccagctcggcgcacgtcagggcgcgggcgcggtgtacctcaacgcccaccaccctgatatcctgcgcttcctggataccaagcgagagaacgcggacgagaagatccgcatcaagtcgctggctcttggcgtggtgattccggacatcacgttcgaactggccaaacagaaggcccagatggccctgttcagcccgtacgacgtggagcgcgtgtacggcaagccgttcgccgacatctccgttaccgagcattatgacgagatggtggccgacgaccgcatcaagaagacctacatcgacgcccgtaagttcttcaccaccatcgccgaactgcagttcgaatccggctacccgtacatcgtgttcgaggacacggtcaaccgcgcgaacccgatcgaaggtcgcgtgaccatgtccaacctgtgctcggaaatcctgcaggttcaggagccgagcgcatacaacgaggacctcacgtatgcgcatgtcggccgcgacatctcctgcaatctgggttcgctcaacatcgctaaggcgatggatggcggcttgggccacacggtggagacggcgatccgcgcactcacctcggtggccgagcacaccagcatcaacgcggtgccttcgattcgccgcgccaatgaggagggccacgccatcggtctcggccagatgaacctgcacggcttcctggcccgcgaaggcatccagtacggttctgaagagggcctcgacttcaccgacatgtacttcatgaccgtggcctaccacgcctaccgtgcctcgcacgcgctcgccgtggagcatggccgcacgttcgccagcttcgctacgagcgactacgccaagccggccggccagggcaactacttcgacaagtacaccgatggtcgtcgttcgctcactccgcgcaccgaacgggtccgtgcgctgttcgaacagtacggcatcgcgatcccgactgcggccgactgggaggccctgcgcgacgcgattctgaaggacggcatctacaaccagaacctgcaggccgtgccgcccaccggctcgatctcgtacatcaaccattccacgagctcgattcacccgatcgcctccaagatcgagattcgcaaggaaggcaagatcgggcgcgtgtactacccggccgcctacatgaccaacgacaacctcgggtactacaaggacgcctacgagatcggctggaagaccatcgtcgacacgtacgccgaggccacccagcacgtggatcagggactgtcgctgacgctgttcttcccggacaccgccaccacccgcgacctcaataaggcccagatctacgcctggcgcaagggcatcaaaaccctctactacatccgcatccgccagcaagccctggaaggcactgaagtccaaggctgcgtctcctgcatgctctgatcgttcgagggagcgtataccgcctttcttcggcactcgacgtaccttcgtacgccttcggcctcagacggcggtctccgcacgcattgaacaaccagagagccgttgttactcccctcactcggctaacgccgacagctcccctcagagaggggagctggccgcgaagcggactgaggggggctccaccatctaaggaaccaacaatgtcacgaaccgtctatagagcactgctccggctgaccgcgccggaggagttcgaaaacaaatccaacgacgataacgacaacgagtaaaaggaacactactcatggcaccgatttccattccgcgcaaaccgctgaaactcatcgaccgcgtctccgcaatcaactggaaccgcctcgaagatgagaaagaccttgaggtctgggaccgcctgaccggcaacttctggctgcccgaaaaagtccccgtctctaacgacatccccagctggcagaagatgaccgaggacgagcacacgctcaccatgcacgtgttcaccggcctgaccctgcttgacaccatccagggtacggtcggcgccgtctccctgattccggacgcgctcaccccgcacgaggaggccgtgtacaccaacatcgccttcatggaatccgtgcacgccaaaagctactcgtccatcttctccaccctgtgctccaccgaacagatcgacgcggccttcgactggagcgagaacaacgagttcctgcagaaaaaggcggaaatcgtgctcgactactacgagggcgacaacccgtacaagcgcaaggtggcctccaccctgctcgaatcgttcctcttctactccggcttctatctgccgatgtacttctccgcgcacgccaagctgacgaacaccgccgacgtgattcgtctgattatccgcgatgaggccgtccacggctactacatcggctacaagtaccagaagggcatcgcccagctgagcgatgccgagcgcctggatctgcaggactacacgtacgacctgctcaacgagctgtacgacaacgaggtggagtacacccagtcgctgtacgatcgcgtgggcctgaccgatgacgtcgagaagttcctgcgctacaacggcaacaaggcgctgatgaacctcggttacccggctttgttcccggctgagatttgcgatgtgaaccccgcgatcctggccgccctgagcccgaacgccgacgaaaaccacgacttcttctccggctccggctcctcctacgtgatgggcaaagccgaagaaaccgatgacgacgactgggacttctaagggtttcgcggtccgcgaacccgcagcgccgccgcgttcgcacggcggcgctacgctggagatatggaacaggagccgttggtcagcatcatcatcccggtatataaggtcgagaagttcctcgacgaatgcgtggcgtctgttgccgcgcagacgtacgccaatctggagattctgctggtcgacgacggctcgcccgacaattgcccggccatgtgcgacgcctgggccgcccgcgacccgcgcatacgcgtgattcacaagcccaacggcggcctgtccgacgcccgcaactccggtatcgctgaggctatcggcgcgtacatatacttcgccgattccgacgacaccgtggcacccacgttggtggaggactgcctgaacgccatgcgcgagtatgacgccgacctcgtgatgttccagttcgacaccatctccgagaacaacaagccgctgctgtccaactatcgccacaacgacttcaccgaggtgcaggtcctgaccccggtcgaggtcatcaaaaagcaagtcaaggctgagattgacggctatttctgggccttcctggcacccgcctccacctatcagggcaccggattctccttcccggtgggtcgcaaaatcgaggatctctcccgtatctgcaacgtgatcggcgaggccacgcgcgtggtccgtctgcccaaggcgctgtaccactaccgcatgcgcgagggatcgattaccgccaactgggatccgcagctcacccgcgactggacccgcgccgccgacgaccgcgaggaatacatcgtccaccgattccccgagctcaagggcttcatgacgctgcaacagctgaatttttttgccaacctcgattacgagaccatgcgccagtcgctgatcgccgggctcaagatcgatcccgaggacgccgacgcgcttcgtcgccgcatcgagggcctgaccaagtccgccgatgagggcgatgagcccgtaccggaaacgttgcgtgagttgctcggactgctcaagctgggcatcgccaaggtggccgatggcacgttcggtaaggccgatggcagcagtactgatggcgatgccgagaacgatgacgtaacgctggccgaccgtttccgcgacatgcgcgaggactggcgccagctgcgcatccagcgcatcgaagacgccgaggagcgcaaggccgagcgcaaagccgcccgcaacggcgtcaccttcgagtctgtgtcgcattagtcggcgactgatggaatccatcagtccgggaagagcagacctgctctacgtcgggcgtgccggttcgcacgttcgagaaacaggcgtgtcatgggccgaaccacacaacacccccagaaacgcccataaagttaactacatttcagacacgccacttcccgatgtctatttagaagtgcaacacccttgttggtcctgtaattctaacagttcgtcggcgaacgcctcggcgggcgtgcggtagccgagcacgcgcatggggcggttgttgatctcgtcgacgatctccctgacctcctttgccatgtccatccggatctcgcagcgtttgggcagataccggcggatcatgccgttgcggttctcgttgcttccccgctgccagctggagtacgggtcggcgaagtacgtggccatgcccagcccgtcgcgcagcctttcgtggtgggcgaactcggtgccgttgtcgtgcgtgacgctgacgcgcgcgccggccggcagcggcgagaacatgtccagctgcgccccgacgctctcgccggcggtcttgtccggaacgatgcgggccatgaggaacctggtcctcctctccacctcggtgtgcaggttgcatcccactccgatgacgctgtcggcctcccaatggccgaacgcgctcctgccgtcggcctccggcgggcgttcggagatgggcactcggccggggatcgggaagcgcgacgtcctcctgccgccgtgcctgcggcgccgcctgtgccctcgcggcaggcaccgcgcccagcgttcccgaagcggcctgctggagtagacccatcggtagatggtctccgggcacacgcgcatgagcgcatcgtccggccacaggacgcgcagcctgccgctgatgagcagcggcgaccagccgcggcccagccattcggtcacctgcgcccacaggcggtcgtgcgacagccggtagggctttcgtggcttggatctcctgcggtcggccttgcgctgcgcgggcccggcgatgtagtagcggccggtccatggccccgccttcagtcttttcggccggtacgggcggtacgactcgttctcgttggacgggaaccatgtgttgcgcttgatctcccggctgatgctggacgggctgcggcccagcatcgcgccgatcccgcgtatgctggcgccgttgcctacctcgatctggatgacctggcgttcctcttccgacaggtgcgaatatacttctcccataggtgcgacatcccttcggactggttttctaggcaatttccaatctaacgggtgttgcactttcatttagacaacgggcttgccttggtccacggtccgtgtatagtagttctcggctcaacgaagagaaccttcactgaaccggaaaaaagtaaacgctgaagcttgcagtttccgaaagcaaagttgtacgtcggtggcgagggcggaagcacagtaaagaacaaatccctttacaacggatcgtgaggcacgtacctgcctctgaaaggattagtaattatggcagaagtcgttttcgaccacgtcactcgtatctacccgggcaacgataagccctccgtggatgatctgaatcttgatatcaaggatggcgagttcctcgtcctcgtcggcccttctggctgtggtaagtctacgacccttcgtatgctcgccggcctggaagaggtcaacaagggccgcatcctcatcggtggcaaggatgtcaccacgatgcagccgaaggaccgcgacatcgcaatggtgttccagaactacgctctgtacccgcacatgaccgttgccgacaacatgggcttcgccctgaagatcgccggcactccgaaggacgagatccgcaagcgcgtcgagaaggccgctgagatcctcgacctgaccgagtacctcgaccgcaagccgaaggctctgtccggtggtcagcgtcagcgtgtggccatgggccgtgcaatcgtccgtgagccgaaggtcttcctcatggatgagccgctgtccaacttggacgccaagcttcgtgtccagacccgtacccagattgctgccctgcagcgccagctgggtgtcaccaccctgtacgtgacccacgatcagaccgaggctctgacgatgggcgatcgcatcgccgtcatcaagctcggtatcctgcagcaggtcggcgccccgactgagctgtacgatcgtccggccaacgtcttcgttgccggcttcatcggctccccgtcgatgaacctgaacacccacccggtggtcaacggcaaggcgaagatcggtgaggacaccgtggacctgccggctgaggccgtcgccaagctcaccgccgaagacaacggccagatcgtggtcggcttccgtcctgaggacgctggtctggccccggctgacgacccgaacgccttctccctgaaggtcgtcaacgtcgaggatctgggctccgatggctacatctacggcaacatcatcaccgatggctccgccgctgaggcttcccaggtcatgtccgaccagaacaagctcaccacgattcgtgtgaatccgcgtgcgctgccgaaggttggcgcgaccgtcaagatcaagatcgacccggccaagatgcacctgttcgctccgtcgactgagctgcgtctgaactaatagatacttggcgaggtctaatcgcttcgtcaaccattaaacgaggttattctcttcctctcttatgacctcgttggaaaagccctgcatagctgcggggcttttcttttgccttttagacggtctgagggagagaccaaacggtgtttttcccgtaaacataacgcgccgaagtcgtggcaaaggagcacacatcgcgaacgacacgtaaaatcgaacacatggagttgaacgaattgccccagatggatccgcgtgcgctgaaggccacgtctgtcaaagccgaagacgaacacgccaattcagccgaaccgcaagcactgaaaatcaccgccgccagctcgaacccaaagatgttcacgctgccctggcacaagcccttggccacctggcctaaggacctgctggccaacctgccgcgaggcatctcccgccacgtcgtgcgattcgtgcacgtgggcgacgaggtgtacgccatgaaggagatcacgcgccaggtggccgagcgagagtacgagatcctgcgtcgactgcagaagctcgaactgccaactgtgaccccgatcgccgtggtcatcggccgtcatacccgtgaaggggagccgctggaggcgattctggtcacccggcacttgaagttctcactgccgtaccgtgcgctgttcgcccgcaacctgcgcccggacaccgccgaacgactgatcgacgccctcgccgtgctgctggtgcgcctgcacctggccggcttctactggggcgatgtgtcgctgtcgaacgtcctgttcctgcgcgacgccgacgctttctccgccttcctggtggacgccgagaccggtgacctgcaagcccagctcaccgacggccagcgcgaatacgatatcgacttggcccgcaccaacatcatcggcgaacttatggatttggcgtccggcaagctgctgcccggcgacgtggatgagatcgaggtgggcaaccgcctagtcgaccgctaccactcgctgtggagcgccctgaccgacaccgacaagttcaacccggacgaaatgtggaagatcgagcagcgcgtcaacaagctcaacgagctgggcttcgacgtggacgagctggaaatgaagaccgccgaggacggcaagcgtgtgctggtccgcccgcgcgtggtggacgccggatacgccaaccgcaagctgctgcgtctcaccggccttgacgtgcaggagaaccaggcccggcgtctgctcaacgatcttgacgcctaccgtgcctccacgtggcgtgagggcgaggatctggaaatcgtggccaccgactggatgcgcgaggtgttcgagccgaccgtgcgtatgattccgcgtgaatatcgctcccagatcgagcctgctcagttcttccatgaggtgcttgaccatcgctggttcctggcggagaaggccggccacgacgtgccgatgggcgaggccgtgaccagctacatcgacaacgctctgccgagctacagccttgactccaaggcactcgccgaacttaacgaagaggccgattccggcgtcattgacgacgaatccacctacagcgacccggacgacgacggctacaaccccgatgacgatccggatgcggcagtgtggagtcattaagcggacaatccggtggactgtctgtaggtgagcccatcacacaaagaagcccctcaaatagaggggcttccgtgtatgtacaacctattacggcctcaagcgacaatcactccgccgcagccttgcgccgtgcgttggacaccgcgtacaggctgatacccgccgccactgaagcgttcagcgactcaacagacgagctgatcgggatgccggcaatcgcgtcacaggtttcgcgcaccagtcggcccaaaccgctgccttccgaaccgagcactacaacgagcggatcggattcaaagccagtctcgccgacgagcttatcgccgccaccgtcaaggccgacaacgtagtatccacgctccttcaagccctcaagtgccttagtcaggttcaccacgcgcgccaccggcatatgcgcggccgcaccggcagacaccttccaagcggcggcgttcactgaagcggaacggcgttccggcagaatcacaccattggcaccgaatgcggccgccgaacgaatcacggcacccaggttctgcggatcggtcacgccgtccaatgcgataaacaacggtcgcgcagcaatacgggcggccgccgaattcgcggcctccattgccttggccttcttctcagcacgatcggccagctcgttcagcgaggagtactggaacggatcgaccttcagaatcacgccctgatggttgccagagcgggcgatacgatccatctccagacgatcggcctccagcatgtgcaggccgttcataccagcgattttcacgatttcgcgagtacgatcgtcatgttcaatacgagacatgatgtacagcgtggaagaaggtacgcctacgcgcagtgcttccagcacggaattacggccgtacaccagatccgaagtatccgccgaagcgaacttgtccactcgacggcgggctgccagacgcgggtcggccatctgccgacgttcggccgctttcttggccttgtacgccttgtgatagacgcggtcctcggccttgggagtggggccgtagcccttcagtttgttgcgatgcttgccacccgaccccttggtcggtccttttttgatagccataggtgctattgtcccagcaccccgcgccaaaacgcggctattccgccgtcggtagccggtaaggtattgagagtgaagaagcagcgtatgatattcggactgtccctgctgtattggggattatggttggcgattctgattctgtggatgggtcgcttcgtgacctcattcttgtcgatatatttggtttccgcgctgcgcctcgatgagggtgtggtgggcacagtcgtggccatgtacggcttcggcgcaatcatcggctgcctgttcggcggtaccttgtccgacagattcggccgccaatccatgattatcatcggcgaaatcggcgcagcggctgccctgctggtcgtttccgtactcactgatcctgtgtctttaggcgcggctctgttcgtctatggtgcgttcgcctcgctgcccagcccggccatcgccgcgtatatcgcggatgtggtgcctgccgaacgtcagcaacgtgcatacgtactgcaatcgtgggcgattaattttgggtacgcgattggaccgattgtggccaaccagctggtcaagatctcgtattcgctgatgttctacgttgaagcggcggtgatgatagccgtcacgatattgctgattgcgttcttccgcgaggtgcggcatttggggattactgtatcggtgccaagtgcggtgcgccatgaagacgaatgcagtgttacccatgcggaattcgccggcattgagaggccgaatcactcggatgccgcaccggctgccagtgtcaagggcgccatgtctcgcaattggcggcgcgtgctcaccgatactccattcctcggcttctccctgctgatgttcggctacttccttgtgtacttccaaagcacctccggcctgcccattgccatgacggaccttggtctagggctgggcgagtattcggtgctgctcaccatcaatggcggtatgttgtgcctgctgcagattcccgcgatgaaactgttcgcgcgcatgggcaattcacgcgtgctggtgatgggcctcgccgtaaccgtcatcggctatgcggtgcaggccgcggcccattcttggggcggattcgcgcttgccgtagtgctgtggacgctgggtgagctgggcacattccctatcgccaccactacggttgccgccatggcacccgcgtcggcgcgtggcacgtatcagggcgtctacaacgtagtgtggtcggtgtcggttgcgctggcgccgctgattggtggctggactatcagcaacttcggcggtcgaacgctgtggatcgcctgcactgttgtgttgattgccgtgaccctcggtctcaagctcaccaaaggctcgcgcgaccgcgccatggcccgcagtcttcacgattcgctgtaagtgttattcggtttggagatacgggcaagaccgcatatggcgagtggttcttatcgagaactattctctgcgcgtatgatgtatggcatgcaatacattcaacaaaccatcgttggcattgatggcagcgaggcgcgattctttggctatgtggccgacaacagcgaggagatggaaccggaccgtatacgcccggccatcctgattttgcctggcggcggctacgccatgacttctgaccgcgaagccgagccagtggccctgcaattcctggccaaaggcttcgccgtattcgtgctgcgctattcggtgcagcccagccgctatccggtggctttgctggaggctgccgaggcaatgcgcctgattcgcgccaatgcggatcagtggcatgtaaaccccgcgcaagtggccgtactcggcttttccgcaggcgggcatctggccgccaacctcgccacctcggtcggcgacgaagacatccgcgaacagggcggcatggacccggacgccgtgcgcccgaacgcgctgatgctctcgtacccagtaatcaccgccggcaagtacgcccatcgcggcagcttccaatgcctgctaggggaccaagctcacaatcaggctttgctggacaagttctccatcgaaaagcacatcgatgccaaaacgccacccgtcttcgtctggcataccatgaccgacgacgccgtgcccgtggagaacacgctaatgctcatccaggcctgccgggccgccggcgtgagcattgaggcgcacctgttccctgaaggcagccacggcctgtccttggccaatgcggaaactgccggtaacggcttctacgcgcacatcgtcgaatgcgtgcagtgttggcctgatttggctgaggcctggttgcgtcgcctgttctaggcaaaacgctattacgctgtgcgccaagtgcgccacgcggttatggaataatggcaatcgtatgcatcggcagcagttgcgccggtgtccataaccgcgcagtcctgtgcgtccagccgggagagaaaacccggcagcggccgcaaggctgactactccgcggcaataccaaggagaacattatggatgatctcaaagatcaatccgcagtgtccacgaccgcaacgaacggggtcgtggaatcggaagaggtgcgcgcacaggaagcgctattgggggatactgatccaagtctgaccagcgccgacgacgtggccaaagccctgaacgtcgacccatcccacggcctgagcgaggaagaagccaagcgccgactggccaaattcggcccgaacgagctcgccagcgccccgcccgtaccgaaatggaagaaattcctagcccaattccaagatccgctggtctacctgctgatcgcggccactattatctcggtgatcgcttggttcatcgaaaaagccaatgcgcagcccggcgcggaaggcggcgaagtgctgccgttcgacgccatcgtgatcatcttgatcctgattgtcaatgctgtgctcggctatatgcaagaagccaaggccgaggcggccgtcgaagcgctcgcacaaatgacggccccgcagacctcggtgctgcgcgatggcaaggtcatgcgcatcaacaccgccgacgtggtccccggcgacatcatcgtccttgcggaaggcgattcggtctccgctgatggccgactggtcaacgcggccagcctgcgcatcgccgaggcttcactgaccggcgaatccgtgccggttggcaagaagccggacacactcaccgaagccaaggcgctgggcgaccgcgccaacatgatcttcaacggcacttccgtgacgcaaggcaccggccgcgcaatcgtgaccggcaccggtatgaatacgcaggtcggcaagatcgccgacatgctctccgccaccgaagatgagaaaactccgctgcagaaggagatggattacgtctccaagatcctcggcattgcggtgtgcgtcatcgctgtcgtggtgctggtggcgctcgccgtgctggaaggcttcaacgacgtccatgacgtgattgattccttgctgttggctgtctcgctggctgtggccgccgtgccggaaggcttggccgccatcctgaccgtggtgctggcgcttggtgtgcagcgtatggccgcgcacaacgccatcgtcaagaaactgcattcggtggagaccttgggctccgcttccgtgatctgctcggataagaccggtacgctgacccgcaacgagatgaccgtggaacgtgtggtcaccccgtccggcgaagtgcagatcactggcaccggttacgcgccggaaggccgcatggttatgaccggcggcgtcagtcctgaatccgagcaggcccagattgtggccgatgaagtcgtcgccacgctcgtggccggcacgctcgcgaacgacggcgaactacgcgaggagaacggccgttgggagattgtgggcgaccccaccgaagtctcgctgatcgtggccgcacgcaaggtcaaggccgatcgcaagatcaagcgatacacgcgcgttggcgagattccgttcacctctgaacgcaagcgcatgtccatcattgccaaggacagcaccgattcagacaagctcaccgtgttcgccaagggcgcgcccgacgtgctgttgagctactgcacgcgcatccgcgtgggtggtcaggtccgtaagctcaccgaaggcgatcgccagtcgattctcgccaccgtcgaacgtctctcctccgaggcctaccgtacgcttggcgaggcctgccgtccgctggaaaccggttctttggctgatgtgcccggtgtaagcgtcaacgctgcaggccaggtgtccgacatcgccgatcaggccgaagccattgaaaccgatctcatctggaatggcatggtcggcattatcgatccgccgcgtactgaggtgcgcgactccgtgaccgaggcccatcgtgccggcatccgcacggtgatgatcaccggcgaccacccgctgaccgccgcccgcatcgcctccgaccttggcatcatcgccaaggatggcaaggccctgaccggcgaccagctcgaccagctgcccgatgaggccgcgctcgacaaggccacgtccgaagtgtccgtgtacgcgcgcgtggcccccgagcacaagctcaagatcgtcgaatccttgcagcgccaaggcaacatcgtggccatgaccggcgacggtgtgaacgatgccccggcagtcaagtccgcggacatcggcgtggccatgggcatcaccggcaccgaagtgaccaagcagagcgccaagatgattctggcggacgacaacttctccaccatcgtggccgccgtacgcgagggtcgcgtgatcttcgacaacatccgcaagttcctgcgctacctgctgagttccaatgtgggtgaggtgttcaccgtgttcctcggtgtggtgtttgccggcttcctcggcatccgccagccggaaaccgtgggcgtcaccgtgccgctgctcgccacacagttgctgtggatcaacctgctgaccgatgccgcgccggcgttggctatgggcgtggacccgcagaccgacgatgtgatgggtcgtaaaccgcgtaaggtgacggaccgcgtgattgacgcctccatgtggggcgacatcatctacatcggcgtcatcatggccatcgtcacgctgattggtatggacatgcacctgtccggcggcttgttcaccgaccgctcggtggatgccatcggccatgaagcgcagatgaccgaggcccgtacgatgggcttcacgattctggtgtttgcccagctgttcaacgcgctgtcctcccgttcgcatctgcagtccgcattcgtgggtctgttctccaacaagtggctatggggtgcgattggtttgtccgtggcgctgcagctcgtggtgatttacgtgccgttcctcaacggtccgttcggcaccgtggcattgagcccgatggcttgggtggaatgcatctgcctggccgcaatcgtgctgattgcctccgaactgcgcaagattgtgctacgcgcgatggccaagcgttaagccatcgcaatagccctgattgtgggcatatagcagtgggccgggctctggtattcagagcccggcccactgctatatccaaacggctcctcatggggcggtaactatcccatggggcggtcgctgaaaacggcattattccgcgaaaaaggaaaatatgctaaccgccccatggggagttaccgccccatgggaaacaggagaacgctgcagacctcagttgttgctgccgtcagtgccgtcagtagaggtggagttgtcgccgccgttattgttgtcgctattgttggactcgtcttgagacttctgctgtgcctcttggtcggccttctgctgagcctcttcctgagcttgcttggcggcatctgcctgctgcttggcctgcatcgaggcggtgacgtcggactcggccttctgcagtttagaaatcgcattattgacgtcggattcggacggactggtcccgttcatcaccgtattggcctcggtgatggcgttttgcagcgcggtgcgggtgttttcatcggccacactgcccgcggaattatccagcgtgccctgcgcctgcgaaatagccgagctcaggttcgatttcagtgtgttggtatcggccgtcgcctttgaagtattaacggccttgatcgcgttgttgatggcatccgtcttgtcagccatgtcgctggcatcattctgcagctctttagtgtgagacttcaactcagtggcgttgaggctggaatcgcacttggcggtgtcagccggattgccggcgtcttgcaacgcctgatttagcgtggtgagcgtattggcatcggccacatcgctggtggatgtttgcgcgctggtttggccattggatatggcggtggtgagcttcttctgagcattcgtgtactgcttggccgctaccttgcactcggccaatgccacggcttggctcgccttgctgctgttggaatgccaccagagcaggccggcgacaaccagcgctatcacggcgactactgctacggcaatgccgacgatcttgctggtgttctttttgccgctaccgccgtgacgaggctcggcgccatcggaatcgtcctcatcggagacctgatccaacggaatggagggaggcatcacagcaggctgagcctgtgccgaagcggccagggcggccggttggaacacctgtgtggctgcagcatcatcggcagacgctacttgcgttgccggcatggcaacggtctcaccggatacggtggatgatgcgccgtatgcctgtgcggccgcggtttcggcattcggcatggcctgagcttcgaaaggctgtgttgccatgacctgatcaggctggaacgcttgtgttgcctcggcatctaccgcaggctgctcggcctgattggggtggaacgcctgtgtcgcggcgtttgaagctaccgaaacaggcgatgtcgccggtgccgctggtgcggctggtgctgctggcgtcaccggcgctgtcggttccaccgggcggaagctttgcgtcgtctgatcccaaacgtattgctgctggccgggcgcagcggcgattggtgtttcggatactactggctgcgtggctgccgccggctgtggtgcttgtgcggcaaccgcagccaggaattgcggcgagaacggttgcgtcatggccggatcgatgggctgcgtcggctgagcggcttgtacggtcggcacagcttgcgtgggttgtgaggcatacgctacttgcgcgggctgcacaaactgtgtgggctgtgtgggctgcgcagactgcgcagactgcacagactgcgggaactgcagagccggtgtggcttgtgccgtgggttctgtgctatatgctgccgtctcttgcccgggaatcggaggaaccgttggcctgaccggcttttcgggctgctggaagtcgaactggaacccgccatcgctgttggtcatgacatctccttgggattaagcaaatggccggcatccgccggccgaatggtacgtcgcaacgctcagtcgtcgatgtgcgcgcggtagaaattctcgtaggaacggctcggcgtcggaccccgctggccctgataatgcgagccggtgcccttggagccataagggtgctcagcgggcgagctcagctggaagaagcacatctggccgattttcatgccaggccatagtttgaccggcaacgtcgacacattagacagctcaagcgtaatatgcccctcgaaaccggggtcaatgaagcccgcagtcgaatgggtgagaatccccaatcggcccagtgagctcttgccttccagacgggcggcaatggacgggtccaacttgacgtattcccacgtggaacccagtgcgaactcgccggggtgcaaaatccacggttcgtcgggagccacctcgaactgttcggtgagcgcgccttggttttccgccggatcgacataggtgtaggcgtggttattgaacaaacggaagtaccgatccaatcgcacgtcgatggaagcgggctgcaccatttcgggggtccacggatcaagtgagatatgacctgcggactgtgcggcgagaatgtcgcggtcggacagcagcatgtgaaaaactccttgggcaaataaatactgccttcaagtctagcgccttgggcggaaacgtgagaggctcctcacgcttccgcggtccatcaatcgcaagtattttcaggtttttctcagagaaacttagaggtagacccagaaagcagtggttatataaaagatgtcagcggaaagctgatcaggagccgcagcagttcccgacaattgaaccccctttcttcttctctctcctttctctccccggcgggcaaccgccggggttctttttgtgccctgaatcattcccccgaatgaccgccattcccaagccatagcggtacactagctgtgtaatcggcaggaagggggcaccgatggcccgcaacgatgaggactacgatttcttcggcgatggtcagtatgacgattcgcgcagctcacgtcgtgcacagaatcgacgcccatccaggcgggatgccggccggcgattcgccgctacaaaagccagcagcccaacgtcgatattgtgccgcagacttgccgttgtcagcggactgctagccgtcgtggtatcggccacctcggcggttcatgagatcgcgccttacgccatttcctttatgacggcagtgccaggacgatacattgcgttgatggcggcggtgcttatcggcatcaccctgattctggtcatcgctgcgcgagtcaccatgcctcggtacgccactcacgggggagtgggcgcgggcggcatcatcgcactggtgtgcgccatagtttgcttggttatcggcgtggccgcgggcgtattgttcccggaaggactgattcagcagtcgaacgacaaggcacccgtcgaagataccgcacagatggagcaaggcatcgaacaagctgccggcgcgtgcaaagaaggatggcaggggcttgatacgggcggtttgccgggcatcaccaccgtacagatgtgcactgatccgagagtggccttcgtatcctttgaatcggaatcgtccgcagccatcagccgggcacctatcgaaagcaagatttccgaactgctgagccaatacgctgataatgagcaaacgaaaggtgattggcgattgctgaacggcaaacgctggatggtgttcggcgaggccagcaagatgaccgcactgcagcagcagtggggcggcgaacttgagacaatcaccgcagccgcagataccgcagacagcggtaacgcctgacagattgccggtatcccttgaaaagtcccaaggcgattcggcgcggattacccaatgtgattgaaatcatggtccatcgttttccgcacagcgcgcaagacctctatattggaatggtatgagcaaagaagcgaatgccagccagcctctgatcggccgcgaatccaccactgtgcccggacgttttggcgagccactcaccgtggagcacagcgtcacctcgcgcggcggcttcgaccagcatgccgcgcatccgctgttcctgtgcctgcacggatggggatccagcgaagaagacatggcggacatcatgcgcctcatcgctccatataacgatttcgtggcattgcgcgggccgctgacactcgcgccggcccgtgagggcagtctcgaccccggcaactacgcgtggttccacgatgccctgcctatcggcgatgatcgtgactacgacgcgtatgccgccgccacagcagtcgaccgatgggtggccgacaacattcccgccgaccgtgacgtggtgccgcttgggttttcgcaaggtgggctggtcgccgtgcatttgttgcgtatcaatcccgagcggtaccgggccgtcgtctccctgtccggcttcaacgcacccggtcaggtgcccggcacggcccccgccgactctcgcctggccgattacgatatccccgtgttctatacgtacggcaagaacgatggcgtaatcccaaaatacgaactgttcgccaccgccgcttggctggaagagcatacgtggctgaaaaccaagagctaccacggtctggatcacaatgtgagtcttgaggagttcgccgatttgcgccagtggctacttgacaacgacattacctctggcgtgctgtagtcagccgccatcactggaattggcgcggccgtcgcagcaatcggacatcgagggcgcttgtggctgactcggtcatagactgttctcccatgagcgaagtgagcactgcaagcactactgcacatactgaagagaatcatacggaaatagcaatccccaacttggctcccctcagagaagggagcaagggaaactagatgccggaatcagcgtccacttgcataacgtagatgttgcgcctcagggagcgggcttgggctcggttgatgtcgccggcttcgtacatgtcctgaatcataccgagttcgataccgtagctctcgcgctttacgtcctcgacctgcgtgatggtttccgtagtgccgctcatggtcggacgtgcctgcaatgaagcctcggcacgacgataatccagcaacagtgccgaacaatgctcggtgttgtacgtatcctggcccatctcgtcaataagccggccgataacatgatgaatcgcctcgacctgcagttcgcgggtgcgcgcgaaaatctgatcctcgctcaccaatggtgtggtatggcgaatcttggacaccgtgcgtttggcgtaattgctcatctgccgctggaacatgcgtacacgaccgcgaatctgcgataccgcgtgccccgaagtcggatcagtggaagtgtgacgcaacgtattcataatctggtcaagcatgcgctcgcaggtttcgacgttcagctcttgcgtggccgtatccgccgccggatgtgctttggtgtcggcaagccggtcgcgcacgaattccttttcccaatgcagcgcttcgatctgcaattgctcgaatccctggggatcggtatcgccgatgcgctgctgcaatcgcccgatgcgcttggtgtactggtcgattaccatcagaatcgcacgacgattctctggcgtgatgcgtccggtcaattcctccaccgtggcgcgtaacacatcgatggtcaccggaattatttccgcgctgggatccttgccacggttcggggccaatagcggtaacaggaagttggccagcagcaaggtcgcgataatcacgcctgacgcaatgaaaatcagctcgtcacgcatcgggaacggcgcaccgccggcaatgtaatacgggatggtgaacatcaatgacagcgtgatggttcccttggggccgccaaaggtcatcactgcggccgagcgccagcgttcgggtgtcattttgcggcgctggccggagattgtatctcgcgccacgcgcagcatggccgcaatccagaagaatcgaagcgcgattaccaccagagtgaccagcagaataatgccgatcagcacggtattgctgatatacgggtcagaccagctggccctcatggcgcgcggcagctgcatgcccagaagaatgaacaccgcaccgttgagcgagaaactcagcacaccccatactgaagtggaaacgatattcgtacgtgccacattcggccccacgccggtacggtcgaatcggatgaacaggccagcggccaccaccgacagaatgccggacacattgaattcctccgcgcccaaatacagcaggaagggcaggaacagttccatcagaatacgtgtggtggtggtttcccaaccgagggatcgcacggtctcgaatagccagttggccgctgctgctatcaccaggccaaataaggtgccgccaaagaaggagatcacgaattcgccggcggcctgccccacggcgaattcgccagtgaaggcggcggccagagcgaactggaagccgacgatgccggaagcgtcattgaagagtgattcgcctttcagcacgctgcgctgacgctgcgtcagcgaggcttctttaccgagggagctgacggccaccgcatcggtcgggccgagtgccgcgccgagtgctaaggctgaggctaaggtgatggacggccagacggcatgcaaagtgaatccgaccgccgccatcgtgacgatagccagtccgatagccagcgataggctcagatccagcgttttcagcaacgccgacttatcgatttcgtgggcttccaaatacagcaatggcgcgataaacagcaccatgaacagttccgggtcgagcgttgcatccgggaaaaacggcagatacgtaaccagcacgcccagcacaatctggaccagcggcgtggagactttgggcacgaagcgactgacaaacgagctcaccaccaccgccgcaatgatgcataggatgagctcaaataccgccatgttgccgccttctcccttaaatttttctccaccaaaagtatatgggaaccatgaagaaaacgttaagcttgcggccgattatgcacatcatgagacgatatgagaaaaggcatacactcgttggtatggaatatgacgaggcgatgcgccgcgcactggaactggccggtcaggctgcagccgctggtgacgtaccggttggtgcggtggtgctggatgcggccggccagattgtcgggcgcggatacaacacgcgtgaggctgatggtgacccgcttgcccacgccgaaatcatcgccatgcgtcaggcggcccaagccttgggcgcctggaatctcgccgattgcacgctggccgtcacacttgagccgtgcccgatgtgcgcgggtgcctgcatccagacccatatcggcaccatcgcgttcggtgcctgggatcccaagctcggtgcatgcggttcgatttgggatattccgcgcgatccgcatatcggccatagtcctgaagtgcacggcggcgtgttggaaggcgagtgtcagtccatcctgactgatttcttcgcccagcggcgatagacacggacgcattacttacctcacgcaaccaacacgcggcaccaaggcaacatattccatttcttctaccatcgaaaccagtagtgcaatgcaaatccacacacgtcgaaggagacaatatggccgagaacacctcgactttcaccggcgccgccgctgacggcaccgcactcaccgccgtctacctgacccagcccgccgccaatgtggcgatcggtctggtgtttgccggcagcgacctgccgcgcatcgtccactggggccgcccgctggccaagcccgacaccctgctggccgcctatgacgccctgaagccgcagcgcgtgtccggcgcgctcgacgacaccgcctggccgtccatcctgcccacccaggccgaaagctggatcggcgagcagcgcgtggtgctgcgccgcgccggcgtcgagctcttccccaagttcaccgtgaccaacatcgagaccggcggcgtgctggaagccaccctcgatgccgtgtccggcgaaagctacaccgatgtggccggccatgcccgtgccaccggtccggtccgcgtgcccggcgtcatagtcaccgcgcgcgatgaggagcagggcgtggaagtcgaatggcacctcgaactgctccccggcggcctggtccgtcagaaggccaccgtaaccaacctgttcggtgcagacgccggagccccgctcgagatcggcaagatcgagctcggcttcccgctgcccgaatccgccggcgaaatcctcaccaccaccggtcaccatctacgtgaacgcagcccgcagcgccagccgctgaccgtcggccgtttcgaaaagccgcagctcgccggccgccctgacttcgacgcatccctgctcctgaccgccggcgtgcccggtttcggcttcgagcatggcgacgcctattcggtgcacgtgggctggagcggcaactccgtactgtccgccgaacgtctgccctacacaaccggcgtgatcggcggcggcgaactcctgttcggcggcgaagtgacgctcgctggccctggcgaaggccagaactcctacgacaccccgtggctgttcggctcctatggcgatggtctcaacgagatcgccgcccgattccactcctacgtgcgctccctgcacccgcgcctgttctcgcacggccgtccggtgatcctcaacacatgggaagccgtgtacttcgaccacaacttcgatacgctgaaggcgctcgccgacaaggccgccgactccggcgtggaacgattcgtggtggacgacggctggttcggttcccgccgcgacgacacctccggcctcggtgactggcagattgcgcaggacgtctggcccgatggcccgaagtccctgaaggcgctcgccgactacgtgcacgccaagggtatggaattcggcttgtggttcgagccggaaatggtcaaccccgattccgatgtggcccgtaaccaccctgattggattctctcgcccaccgctggccgactgccgctgcagggccgcactcagcaggtgctcgatctgaccaatccggatgcgttcgactacatctacggctgcatggaccagcttgtcggcgagcttggtattgactacatcaagtgggaccacaacaagctcgtcaccgagcccggttcccgccgctccggccgcccggccgtgcacgcgcagacccttgccgtctacaacatcttcaagggcctcaagaccgcacatccgggccttgagatcgaaagctgctcctctggtggcggccgcgtggatcttggcatcctggagcacgccgatcgtatctgggtctccgactgcgtggacccggtcgagcgcgcggacatccagcgctacacctcgctgctggtgccgccggcgatgatgggcgagcacgtgggcgccagccccgcacactccacccagcgcgccaccagccaggaactgcgcatggccatggcgttcttcggtcacatgggcatcgaatggaacctgttgaaggagccggacgaggcgctcgccaagctggccgtgtgggtggccgaattcaagaagcaccgcgactggttcgccatcgacacctgcgtgcacgccgactccaacgatccggccgtgcgtctggacggtatggtgatgccgaaccgtgacgccgccatctaccgcttcacccagctgaccaccagccagacctatccggccgcgcccgtgcatctgcccggacttgaccccgagcgcacctaccgtgtcagcccgcttgacccgagcttggatttgaccggtctgaccaacggccagagcactctcggctggtggaacgaggaaggcgtagtcctgaccggcgaagccctgcagcgctacggcattcgtcccccgtccctccacccccagcaggcagtattgctcaaggctgtggcgttaagctgacagcctagtaggctgtcagtagccacggcctgagcgaagcgacagctgagcgaaggtgggattgagccttgccgataggcaagtccgtaattgctggtcgtggcggagtaactgtggcgaagcaacgttcttggctcccctctctgaggggagccaagaacggcctacccaatatgcttcacaatcacgcgactggcggcggctttggcccagagctgccagtcgtggttcataatcgtgaacttgaccggctgggtctggctgtgacggtagaaacgaatgccgtcacgtagcgaatcggtgccgagcttggccaaaaacgcggactccccggcaatcatcacatgcccgggcatcgcgatgttcgccaccgtagccaccagcgatcccaaccggaaacacgtccggttcaccaactgcgtggcctgcggcacgcgttccttggcatcgcgcgcaaagtcctcaaaactgaccgcgcgacccacaatcgcagagtactgttcggcgattgaatcgtcagtcaagcattgtgaacagccgatatgtccgctggtgcagcgcggcccctccggatcgataagcacgtggcccaccagaccatagctcttatccgggtactgcactggcttgccgttcacggccagcgaataaccaacacccacgccgatggtcaccacggcgaacatatccacgccgacacccggcccgaaccaggaggcatccaccagcagagaatcgatatcattgaacaccccgcacggcaggccggtcgcctctgtgaccatcgtccccaagtccgtggccccgtcccaatgcaggaacggcgcgaacgtcacaatcgaatcgtcgaccacatgcccacctaccgcaacgcccaccgcagtgggggagggtagtccggaagaggcgatatcggcggaacattcgcgcaccagccgcgtgatggccgacaccacatactcagccgattgatccgccccgatcggcacctcgtgccggccggacaccacctcgccatgcgcgttcaccgcagcggccacaatcgacatcccatgaaccttgacaccaatgaaggtgcgtgcgttcgaacacaacaccagcgaagtctgcgggcgtccgcgacgatccgaactttcccttggcgcgaatcgctcgggcagcttgcctgacgggccggcctcggccggaagctcctcgatcaccccggcgtagatcagatcgctggtgatgcgggacaaggccccttggctcagtcccagcatctgtgccaacgtagtgcgggctatcggcccgtattgggcaattgccgccgccacgcgatgcgtatgctcggatccggaaaaccactgtggaatcgcgttggcatcagacatgcaagcccccccctcgctgtatttattgcgttaatcacaaaataccgcgctttttgttgcttgcgcaagtgggctcgctggcgctgggaatgaaatggccgaactgttaccttagaaagtggaagaaccgccggcaccgaagccggaggaaaagaaagataaaggagtcaacaattatgctgtccgattccccacatgcaacgcctagactgaagcgtctggccgtgcgcaccgccgccgtggtgtgcgcgatcgccgtcggcttcggcctggcaggctgcggctccagcaccgcaggcaccgtcacgctggatttcttccagttcaagtccgaggccgccgaccagttcaagtccatggtcgccgactttgagaagcaaaacccgaccatcaaggtcaacatcaacaactccgccaacgcccagaccgatctgcgcacccgcttcgtcaagaatcgcgtgccggacgtgatcaccttcaacggcgacatcagcttcggcaacttcgccgcctccggtgtgttctacgacttcaccgatgaacccattgtggacaccctcaaccccggcatggtgcagatcgccaagaatctggtgcagaccaccgattcctccaagaagcgcctgtatggcctgcccttcgcgggtaacgcctccggctacatctacaacaaggctctgttccgcaaggttggccttgacccggagaacccgccgaccacctggagcgagttcaccgatatgctcaacaccttcaaggacgccggcatcaacccgctgcagggttccgtggccgacggctggaccacccaggcaccgctcgcctccctggccggcacgctggttcccgaatcgaagtacaccgagctcaagcaaggcaagaccacgttccaggaactgtggaagaccacagtcgagaaggaatccgagctcttcacctactccactgcggacaccggcgtcacctaccagcagggcacgcagaacttcgcccaaggcaaggccgcgatcatcccgctcggcacctacgccatcccgcagatcctgctgatcaaccccgatatcgaacttggtttcgcccaggtgccggccaccgatgacgccagcgagcagatcctcaccgccggcgacgacgtgatgctcaccatcggtgcgaacaccaagcaccccaaggaagcgatgaagctcgtcgaattcctcatgcagaaggatcagcttgacgcctacgccgacgcccagtccgccatcacgccgctgaaggacacctacttcggcaacgatgcgctggaaaccgtgcgcccgttcttcgaggaaaaccgactggccgacttctgcgaccactacattccttcgtccatcaacatcggcggctacctgcagaccatggtgacctccggcaacaccgaccgtttcctgaaccagatgcagaccgaatgggacaaggtccaagccaggaccttcgagtgatcggtaggagaggagaacatcatgtcacacgcaaccgcaaccaagaccgctgccaagaaaccggccaagaagaaggtctccgccttctccacccgcaaggtggaccccgcctactactggatggtggttccggcggctatcattttcgccttcttcctgtacctgccatttcttgacggcataaagtattccttcaccaactcgcagggctacggcgattacaagttcatcggcctgaagaactacatcgccctcttccaagacaaccgcgtgggccacgcctacctgttcacgttcctcatcgccattctcatcacggtgctgattaatgtgatcgccctgttcctgtcggtgctgctgaactcgaagatcgccttcaagaatggcttccgagccgtcttcttcatcccctacaccctctccgtgctggtcatcggctacgtgttcaagtacatcttcatgaacccgctgcccgagctcggcaaggcgctgggcatcaagtggctgtccacctcgttgttgaccaatgagcaactcagctggatcccaatcgtcttcctcgccgtctggcagggcatcgcctactcggtactcatctacctcgccggcctgcagaccatcgacgacgaaatctacgaggccgccgccatcgacggcgtcaacgcctggcagaagttctggaagatcacattcccgctgatcggaccgttcttcaccatcaacctcgtgctgtccatgaagaacgcgctcggcaccttcgatcaggtcgtcgccttgaccgagggcggcccgaactcctccaccgaaaccgtcacctacctcatctggaagggtggcctgaccggtggcgagtacgcctaccagaccgcaaacgccgtgctcttcttcatcgtgctggcgatcatcgccttcgtgcagctgcgcatctcccgcagccaggaacagatctgatttaggggaggataagaaatgactactgcaacagttaccccgtccaagtccggcaagcccgccaagttccgcagagaccacaagatcaactggtggctgaccgccgccgtggccgtgctgagcctgaccattctgatcccgctctacttcaccatcgtcaccgcgctgaagaccccggccgaagccggcaccttcgccctgcccacctcgtggcagtggcataacttcgccgacgcctccgccaaggtcaactacccgaaggccgcgctcaactccgcgatcatcacggtggccgccgtggtgctcaccctgctgaccaacaccttcgtggcctacgccgtggcccgcaacatggacaagcgcttcttccgcttcctgtactacttcttcatcgccgccatgttcgtgccgttcccggtcgtcatgctgccgattgcgaagcagatgggctccctgcacctggacaaccaggtcggcctgatcattctgtacacggtgctcggcctgggcacgaacctgttcatcgccaccggcttcatccgttcgattccggtatcgctggaagaagctgcccgcatcgatggcgcatccacctggcgcatcttctggaccatcatcttcccgctgatgagcccgattaacgccaccatcgccatcctgaccgcgctgtgggcctggaacgacttcctcctgccgttgatcattctgaccgatcagtcgaaccagaccatcccgctcgcccagtacgtcttcagctcgcagttcgccaccaactacccgatggccttctccagctacctgatggccatggccccgatcctcatcgtctacatcttcgcccagaagtgggtcgtcggtggtgtgatgaggggagcggtcaagtagcgtttcactccagctcccctctctgaggggagctgtcagcgaagctgactgaggggagcatcggccgcccgctcaagtaattactttccgccacaccaaaataacagcccgatgggaatgaaaccatcgggctgtttcaatataactacaagccatccggtcaacaacgatgttcgttcacccacgtagaaaggttcggagtcatgactacttcgcaacgtaccgcaatccccgacgccatccgcaccaacggcgccacccccaatccgtggtggtccaacgcggtggtctatcagatttacccgcgctctttccaagacacgaacggcgatggattcggcgatcttaagggcatcacgtcgcgtcttgattacttagctgatcttggcgtggatgtgctgtggctatccccggtctataagtctccgcaagacgacaacggctatgacatttccgactatcaggacattgatcctctgttcggcacgctcgacgatatggacgagctgctggccgaggcccacaagcgtgggctcaagatcgtgatggatcttgttgtcaatcacacttccgatgaacacgcctggtttgaagcatccaagaacaaagacgacgaacacgccgactggtattggtggcgtccggctcgtcccggcaccacgcccggcgagcccggcgccgagcccaatcagtggggctcctactttggcggctccgcatgggaatactgccccgagcgtggcgaatacttcctgcatcagttctcgaagaagcagccggacctcaactgggagaaccctgccgtgcgccgcgctgtgtacgacatgatgaactggtggcttgaccgaggcgtcgacggcttccgcatggacgtcatcaccctgatctccaagcgcaccgattcgaacggcaagctgccgggcgagtacggctcggagcttgaggatcttcctgtgggcgaggagggctattccaacccgaatccgttctgtgcggacggcccccgtcaggatgaattcctggctgaaatgcgacgtgaggtattcgaggggcgtgaaggcttcctgactgtgggcgaggcgccaggcgtcacggctcagcgtaacgagcacatcactgatccgggcaacggtgaattggacatgctcttcctgttcgagcatgttgattttgattgcgaaggtaccaagtggaagccgctgccgcttgacctgccgaaattcaagagcattatggccggttaccagactgccgtgcagaacgcaggatgggccagcttgttcaccggcaatcatgatcagccgcgcgtggtctcccgctggggcgacgactccgcggaggaatcccgcgtccgttcggccaaggcacttggcctgatgctgcacatgcaccgcggcaccccgtacatctatcagggtgaggaactgggcatgaccgacgcccacttcacgcgtctcgaccagtaccgtgaccttgaatccttgaatgcctaccggcagagggtcgaggaggccaaggtgcagtcgtctgagtcaatgatggccggtctggccgcgcgcagccgtgacaacgcgcgtactccgatgcaatgggacggttccggctacgccggtttcaccgctccggacgccgccactgagccatggatttccgtgaatccgaatcatgccgagatcaacgccgccggtgaattcgatgatccggattcggtgtactccttctacaagcaactcgttgcgctgcgtcacaacagcccggtcgtggccgccggcgactggcgactgattgacgccgctgatccgcacgtctatgcctttacccgtgagctcgacgctgagaagttgttggtcgtagtcaatatgtccagtcgaaccgttgacctgccacgtgaggctgccgaactaaccgccgtcggaatcgccgagccgaatgtggtgatcagcacgtatgacgctccgcacaccgtggcctcccttgccaaccgcgagctcgacccgtgggaggcagccgtcatccagttgtagtgcattgagtgcctttctccgctcaaagaggtacttcggggctatcccgaaatgctatctgtcttgagagaggtaccgtaacgtcgaaaccccaggtataagcattgaaaatcaaggcttatacccggggtttttgcttctcggtacccctatgaaaacagatagctgtctgcaaaaggccgaatgtacctctgtgaagcgagatagctggtgtctctcggcattgtggtgcttacaatggaaagctatggaacaaaaggatgttttgaaggcgctgcaacgtgatcatgcagccgaactgaagctggccgccgaacgactcaaaggcactgcccgccacacggagatcattccttctccggtgctgagcgagatgaccggccatgagattctcctgaagccggaaaacctgcaggtcaccggatccttcaagatccgcggtgcctataacaagattgcttcgctcaccgaagagcagatcgctcacggcatcgtcaccgcgtctgccggcaaccatgcccagggtgtggcctatgcggcccgcgagcgtggagccaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactgattccaataccgctggcgggaagccgcgcagaagtgtgctccaatacctcccgctggcgggaggtggcgcaaaagcgccggtgggtggttaaccgacaatcatcagttgcttaacccacccaccggcgctttcgttatgctgagggctacttgttctccgcaatcgtctcgtccaccaacttcggcagggcaacggcgatatcctcatgaatcaagcggctcgcaagatggtcatattgcgtgtgacccatattcataatggtgatgggcacgcccgcctgcgcggccaccggcacaatgctcgccgccgggtacacctcaagggtcgatccgattacccatagttcgtcggctttggtggccagactgtacgacttctccatcgcgccgtccggcaacgcctcaccgaaatacaccacatcggttttgataatgccattgcacggcatatcgccacgatacttcagtttgcgatggcaatgtgggtcgggctcttcatccaaacgggccatgatgtccgccgtggcatattcctgatggcacttcatgcaatgcgaggtgccgatagtgccgtgcaggttcacgatgacgttgtcgctgttgccggccttctcatgcagcgcatcgaagttctgcgtggccagcagcgtcagcatgccggcttgttccagcttgaccagcgccttatgcgcagtgccgggctgcgcattccatactggcgattccttttgccagcgccaggagtactcgcggtcctctttgttgcgcaggaacagatcgatgtcgtaaacgctcatttggtcaggatgcttggtccacacaccgtccggaccgcggaaatcagggatgccggcggacgtggaaatgcccgccccggttaatacagcaatcttcttggtcataactacaggtatacccgcgattcatgaacgaaatccgatgacggagcgctgtcatgcgccgattgtgcgccggcagtgtggttgccgagagatgaacgcagggccgacaagctgaaaactctcgcgacacgccagccgaatagtggatttgatgcttttcagaaacatttgaggggttaacctagcctcatcagagcaaagtgggctctgtgcgacacgccgagggaaccgcgctgttatgccgattccttgggtttttgcgtgccttgatttgcgtgaatccggacatgcgtgtaagctggtcgccgatggccttgtgtaccagagcggcggccacggcggaatcaacgccgccggacaggccgcagatcacctcggcgtcgccgacctgctcgcggatcttcttgacttgatcctcgataatcgaggaggcatcccagtcgttgggcagcgcggcgcaacggtgcaggaagttttcgataagcttctggccaagcggggagtgcttgacttccgggtgccactgcacaccatagagcttgcgggattcgtccgccatggcggccacgggcgcgccttcggtgtgggccagcacttcgaagccggccggggcctgttcgaccgccacaccgtggctcatccacgtggtctgctcggcgggggagtcggcgaggatgccggcggcgtcgtcgatggtggctgaggtcttgccgtattcgccgagcgcggccttatccaccttgccgccgagctcataggccatgacctggaagccgtagcagataccaagcaccggaacaccggattcgaataccttggtgtctatggtcggcgcgccgggctcgaacacggaggccgggccgccagacagaataatcgccttcggatccttggccaggatctcgtcgaccggcatggaatgagggaccagctcggagtacacgcctgcttcgcgcacgcggcgggcgatgagctgggcgtactgggcgccgaagtcgacgacaagcacaggaccgtttgccattgatattcccctaacgttcattggaattttacgtgggctgaacacccctgattatcactggtcaaggcgacaaggccgacacgcagagactatgtgcgcaaatcgaacaaactacatgcctgtagacggacaacacgccgatttcgaacatgggaaatcgaacgtgcgctgttctagccaaatgctggatttccgcatgcttccgccgttttgaaaaagtatgttgaaaaaactaatgttgacaaacggtcagtcgaaccgcacaaatactgaaatatccgcaacaatttcgaacacacccgcaagaaatcgttcaaaagtcgcgttgtcctcgtaccatgacgattgattgggaacggaaaaccttggcaccgcaagggtcagggaccgtgaccgaacagaaataatcaatcgcacgatcacgtgcaggagtacaggagtacacatgacgagtcctgttattggcaccccttggaagaagctcaacgctccggtttccgaggaagccctcgaaggcgttgacaagtactggcgcgttgccaactacctttccatcggccagatttatctgcgttccaacccgctgatgaaggagcccttcacccgcgaagatgtgaagcaccgtctggtgggccactggggcactacccctggcctgaacttcctcatcggccacatcaaccgtttcattgctgaccacggccagaacaccgtgatcatcatgggcccgggccacggtggcccggccggtacctcccagtcctacctggacggcacctacaccgagaccttcccgaagatcaccaaggacgaagctggtctgcagaagttcttccgtcagttctcttacccgggcggcattccgtcccacttcgctccggagaccccgggctccatccacgagggtggtgagctgggttacgctctgtcccacgcttacggcgccatcatggacaacccgagcctgtttgtcccggccatcgtcggcgacggcgaggctgagaccggcccgctggctaccggctggcagtccaacaagctcgtgaacccgcgcaccgacggtatcgtgctgccgatcctgcacctcaacggctacaagatcgccaacccgaccatcctgtcccgcatctccgacgaagagctccacgagttcttccacggcatgggttacgagccctacgagttcgtcgctggcttcgatgatgaggaccacatgtccatccaccgtcgcttcgccgagctgtgggagaccatctgggacgagatctgcgacatcaaggccaccgctcagaccgacaacgtgcaccgtccgttctacccgatgctgatcttccgcaccccgaagggctggacctgcccgaagtacatcgacggcaagaagaccgagggctcctggcgctctcaccaggtgccgctggcttccgcccgcgacaccgaggcccacttcgaggtcctcaagaactggctcgagtcctacaagccggaagagctgttcgacgccaacggtgctgtcaaggacgacgtccttgccttcatgccgaagggcgagctgcgtatcggtgccaacccgaacgccaacggtggtgtgatccgcaacgacctgaagctgccgaacctcgaggactacgaggtcaaggaagtggccgagtacggccacggctggggccagctcgaggccacccgtcgtctgggcgtctacacccgcgacatcatcaagaacaacccgcgcgacttccgcatcttcggaccggatgagaccgcttccaaccgtctgcaggcttcctacgaagtcaccaacaagcagtgggatgccggctacatctccgacgaggtcgacgagcacatgcacgtctccggccaggtcgtcgagcagctgtccgagcaccagatggaaggcttcctcgaggcctacctgctgaccggtcgtcacggcatctggagctcctacgagtccttcgtccacgtgatcgactccatgctgaaccagcacgccaagtggcttgaggctaccgtccgcgagattccgtggcgcaagccgatcgcctccatgaacctgctggtctcctcccacgtctggcgtcaggaccacaacggcttctcccaccaggatccgggtgtcacctccgtcctgctgaacaagtgcttccacaacgaccacgtcatcggcatctacttcgccaccgatgcgaacatgctgctggccatcgccgagaagtgctacaagtccaccaacaagatcaacgccatcatcgccggcaagcagcccgctgccacctggctgaccctggacgaggctcgtgccgagctcgagaagggtgccgccgcttgggattgggcttccaccgccaagaacaacgatgaggccgaggtcgtgcttgccgccgccggcgatgtcccgactcaggagatcatggctgcttccgacaagctgaaggaactgggcgtcaagttcaaggttgtgaacgttgccgacctgctctccctgcagtccgccaaggagaacgacgaggctctgaccgacgaggagttcgccgacatcttcaccgccgacaagccggtgctgttcgcgtaccactcctacgctcacgacgtgcgtggcctgatctacgaccgtccgaaccacgacaacttcaacgtccacggctacgaggaggagggctccaccaccaccccgtacgacatggttcgtgtcaaccgcatcgaccgctacgagctgaccgctgaggctctgcgcatgatcgacgccgacaagtacgccgacaagatcgacgagctcgagaagttccgtgatgaggccttccagttcgccgtcgacaacggctacgaccacccggactacaccgactgggtgtactccggcgtgaacaccgacaagaagggtgccgtcaccgctaccgccgctaccgctggcgacaacgagtgataacacctccacggtgttgttagttcgctaacaccaaagggctcgggattcgtcccgagccctttgcttattcataagccctgtcacggcggggcagaacaaagcgaactgttgtgatgttttaatcgcgtagcaccctgaaatgcagcagggcattgcgcacaccgtcgtggtccacatcgtcagtgatgtagtcggcggcggccttgggctcggcggtcgcattgcccatcgcgaccccgatgccggcgtaggcgagcatatccgtgtcattgccgccatcgccgaaggccatggtctgctcgcgcgtgatgccgtaatgcgccatgaaccgctggatgccgcgcggcttgccgccatcggccggaatcagatccgtgaaatccggatgccaacgcaccccgcgcacattgctgcacagtcccaccagttcggcctccagctcgggtccgacaaagggactgatctggaaagtctcatgatccagcgcgcgggtgcgcgggtcctcgaaataccgggtcggtgcggttttgcccagtttgctccacgtggcgcgaagcagatcattggactggttgaagtacacgtaatccttctcgccgaaattgcacaccacatcggggtgacggtccagccagtcgagaatcacctcaatatcagcagtatccaaggcctgcgaggcaaagaagccggtgtcatcaaagcaatactgcccattgaacgccaccacgccatcgaacgtcaccggcatggtatccagcaccacgtgcatctgtgaaggcgcgcggcccgtgcaaatcagcaccttgatgcctgcggcctgcagccggtgaatcgcctcgattgtggaatccggcaccgtatgggtcgtgaaactggtgagcgtgccatcgatatcgaagaatacggctcggatatcggcattggcggtatcggtagtcatagcttccattgtcaaagcccctctcgacgtgctttccggcgtgttcggcacgcctatagcgggttatcaaacgcacgaatcccggacattgtatgcgcgccataaaagacacctatacggcaatcggccattttccgccactttcgcggttcaagcgcgttatggtgttacccgacatcaattttggagagaggaaatccaatgacagcagcaacccagccggcaaccccggccgctcctaacaataacgagccggtgcgtgtgaaccacaccgcccgcaacgtcatcatcaccatcgtggtcgtggcgattatcgccgtggccgcgttcttcggctaccgcgcgtttgccggtgccaacgagtcgtccgccaagggcagcaagggcaacccggtcaagatcggcgtggtcggcgctaccaaccccgaatgggtcaagttcaagcagaacgccgagaaggccggcatctacgtcgacatcgtcgacttccaggactacacctccgaaaacccggcccttgactccggcgagctggacctcaacgaattccagcacctgctctacttggccaactacaacgtgagcaacaagaaggacctgcagcccatcggcggcaccgccatctacccgctcggcgtgtactccaccaaggtcaaggacatcaaggacctgaagcagggcgacaccgtcaccattccgaacgacgaaaccaaccaggcccgcgctatcggcgtgctcaaggccgccggtctcgtgacgctcaaggacgactggaccgccttctccaccccggccgacatcgacgaagccaagagcaaggtcaaggtcaccccgctcaaggccgaacaggtggccaccaccctgaaggacccgaccatcgccgctggtgtgatcaacaacgactacgtggccgacgccggtctcgacccgaaggacgccatctaccaggatgacgccgaatccgaagaagctcgcccctacatcaacgtgtgggtggcccgcaaggcggacgtgaacaacgagacctacaagaagctcgtttccatctaccagcagaaggatgtgctcgacgccctgcaggagaactccggcggtaccgcggtgttcgccgacaagttcagcgccagcgagctgcaaggcttcctgtccgacattgagaaggatgccaaggcccagcagtgagccgcggctgatacgagcgcacgactaacctatccatagccactaccaccaagcggagcgagtacccgagccaacaatcgggattcgctccgcttccgtgaccggacaccaacaaccagcatcagggagcactatgagcgaccccatcatcaccttcgaccatgtcgtgaaggaattcaaaacacgcggacgcggcgcgaacatcgcacgagccgtggatgacgtcagcctgaccattgatcgcggcgacatcttcggcatcatcggctattccggtgcaggcaaatccacactggtccggcttatcaacgcgctcgaacgacccacctccggcactgtgaccgtgcttggtactgatatcacctctctgagtgagaccaagctgcggcccatccgccagaaaatcggcatgattttccagcagttcaacctgttctccaccaaaaccgtggcccagaacatcgcctacccactgcaactcgatcactggcgcaaggactatcaggatcgtcgtgtcaacgaactccttgaattcgtgggcctcagtgagcacgcaaacaaatacccttcgcagctgtccggcggccagaagcagcgcgtcggcatcgcccgcgcactggccactaatccggagattctgctcgccgacgaagccaccagcgcgctcgacccggaaaccaccaccgaagtgctggccttgctcaagcgtgtgaacgaggaattcggcatcaccattgtgcttatcacccatcagatgaacgtggtccagcagattgccggccgcgtggccgtaatgagcgccggacgcgtggtcgaatccggcgacgtatacgatgtgttcgctgcaccccagcagccggtgaccaagcgattcattgccaccgcattgtctggcctgcccgaggaagaccgggtcgagcgattgcatcacgaatggtcgggccgcattgtcaccgtgcttatccgccaaaaggacgtttccggcacccaaggccatgaactcaaggcatccggacagaatatctccgaactcatcgccaaatacggcgtcgaatccagcctgctctacggcggcatcgacacggtcaaggggaccgccatcggtgccatcacctacgaattcaacgggcccggctggcatgtggacgaattcctgcgcgagctcgccgccaatagcgacgtcatcgacttcggcaccgccgcaaagcctgtggcctacgccgacgcagtcgccggacatgcctcctacgccgaagaccgcgcccatgacccactggcggccgatactgccaccgcgcccgccgcgtccgccgccgcacatgaaggagccaacgcatgatcatcctcgccaacccgcgtagcgactggaacgtgctgcgtccactactgttcgaatccattggccagaccctgaccatggtgctcgtcaccctcgtcatcggcggattcctcggcctgatcctcggcgtggtgctctatggcacccgccccggcaacctgttcgagaacgcggtcgtctaccgcatccttgacatcatcgtcaacatcgtgcgcccgattccgttcatcatcttcctggcagccatgcagccgctcaccatcgtcgtggtcggcacgtccatcggcaccgtggccgccatcttcccgatggtggtgatgtgcaccttcgccacctcgcgtctggtcgaacagaatctcgtgccggtcgacccgggagtaatcgaggcctcgcgttcgatgggtgccggcaagctcaccatcatccgcaccgtgctcatccccgaagccctggcaccgctgatcctggcctacgccttcctgttcattggcgtgctcgacatgtctgccatggccggctacatcggcggtggcggtctcggtaacttcgccatcgcctacggctaccagaagttcgaccagaccgtcacctggacggccgtgatcatcatgatcgtactggtccaggtggtgcagggcatcgccaacgccatcgccaaacgactgctcaaacgccagcaataacaaggcatactgaccccatagatcgcggccctcgccaatatggagcgagggccgcaatatattcttcgcgctactagaatcgggaaccatgagtgaacatatcgacatcgaccacgaactcatcactatccgccactacctgcacgcccatccggagcgtagtttccgtgaattcggcaccagcatctatctgaccgaccagctcaaggcgcacggcatcgagatcctgcacaacccgctggagactggtgttgtggggctcattcagggcgaggccggtcccgggccgcgtatcgggctgcgcgctgacatcgacggcctgcccatcgtggaagactccggactggagttcagctccgtcaatgaaggcgtgatgcacggctgcggccacgacctgcacatgaccggtctgctcggtgccgccttctggctcgccgagcaccgtgacaagttcgccggctcgatcaagattctgttccagccgagtgaggagaccggccaaggcgctcgcgccatgatcgacgccggactcgtggatgacgtcgaagccattatcggcacgcacaacaaccccaactatgcgcccggccagctggccatcggcgttgagccgatgatggccggctgcgtgaaattccgcgtgaccctccacgcccaaggcacccacgccggttacccgtacaagggcaccgggcccatcgaagcgctcgccagtattattctgagcctgcagaccatcgtgagccgcaacgtcacgcccttccacccgctggtgctgtccgttaccgaagtgcacggcggccatgtgtggaacgtggtgcccgccgaagccggattccaagggactgtgcgctatttccacaagtcggatggcaatctggtcggccgccgattcaaggaagtggtggaacacaccgccgaggcatacggcatcagcgccgacgtggtctgggatgactttcaagacccgctggtctccgatccaggtctcgccaaggccgtggcggcggatgtcaacgactacgcgcagctcgaaccgatacgtcagtcgatggcgggggaggacttctgcgaattcgccaaggtgacgttgccggtgttcgcgttcgtcgggtcaaacggccaggaaggttgcgccgactggcatagcccgcatttcgtgggtctcgacgaatccattcccaccttcgtcaacttctacgtcaacaccgctctgcgcgtgctcaacgagctgaagtaaatccttttctggctcacctccggaggctgaggcgttaggcagacagcccagtgggctgtctgtagccgaaggtgaggcgacagccgaaccagatatgcgcgggcctcgcccgtccataagtgcaggacgagctatcagcgaagctgactgaggggagtggcattcgttcattaggtcgattcatcgtccattaggtcggtgaacggcgatactggttgttggaatcgcgccattgcaacgactgatatcgcattgcagtgacctaatgaacgcaaaaacgacctaatgaatgacgccaagccggaagaacaggcaatccgacgtcatacgcggctacactaagaatctatgacacagcttcgcttcgcactcgcccagatcgacacctgcgtcggcgcgcttgacgccaacgccgccaaggtgctcgactactcccgtaaagccgccgcaggaaacgcccaagtggttgttttcccggaaatgaccctcaccggataccccatcgaggatctggccctgcgccgcaccttccgccaagccgcatgggacaaggccaacgaactcgccacccagctcaacgacgacggcctcggcgatctgttcgtggtggtcggcaccgtgggcaccgaccgcaagacctccaagccgcgcaaccgactggtggtcttgcaccaaggcgtggtctgggccggctacgacaagcacttcctgcccaactacggcgtgttcgacgaattccgcatcttctccgccggcgaccgctccgtgaccctcgacgtggacggcgccaccattggcgtggccatctgcgaggacatctggcaggacggcggcccggtggccgacctggccaccaagaacatcgacctgctgctcaccatcaacggctcgccgtatgaggaaggcaagaccaacacccgtttcgagctcgcccagcgtcgtgccgccgaggttaacgccccggtcatctacctgaatcaggtcggcggtcaagacgacctcgtcttcgacggcggcagcttcgtggtcgacgccgacggcacgcttatcgaacgcagcccgatgttcatggaaaacctgacgttctgggacttcgattccgccgccgaacatcaggccaaggccgagatcgttccggaactcgacccggacgaagaggtatacaccgcctgcgtgctcggcctcaaggactacatggccaagaaccacttcaccggcgtgacgctgggcctctcaggaggcatcgactccgcactggtagccgccatggcggccgacgcatgcggcggcgagaacgtctggggcatctccatgccctccatgtactcctccgacggttccaaagacgacgccgccgatttggcctccaacattggcgcccattacgaggtccagcccattgagccattgttcaacgcctaccaacagcaacttgaccttgatggcgtctccgccgagaacctgcaggcccgcatccgcggtgtgatcgtgatggccagctccaattcgcgcggtctgctcgccgtggccaccggcaacaagtcagagctcgcctgcggctactcgaccatctacggcgatgcggtaggcggctacgcacccatcaaggacctgctcaagacccgtgtctgggagatcagccgttggcgtaacaaggccgcggccgcaggcgtcggcatcggcggtctcaagatcgtgggcaacgaggacggcaacaccggcatcccgttgaaggacggcgtgatgattccggtctcctccatcgagaaggcaccctcggccgagttgcgccccgggcagaaggactccgactccctgcccgaatacgcgctgctcgacaaggtgctcgccgcatacatcgagcacgcgcacggccgcgccgacctgttagccgacggcttcgaccaggtcaccgtagacaccgtgatgcgattggtggaccgcgccgaatggaagcgccgccaatacccgctgggaccgaaggtcacggccctcgcgttcggccgcgaccgccgactgcccgtcaccaacgcattcagggaataaacatatattgctcccgccagcgggagcaagtaataccgttgaggaggtaccaatgacagacgataacaagaagcagtggtatttcaacaccgtcaagaagcaggccgagttgggcatggtctcaccgatcgaacagcgcatgggtccgtacaagaccaaggaagacgccgaacatgcgtgggacatcgtggtggaccgcaatgccagatgggaggaggagaaccggcgctggaagaactacggcgtgaaacccgcacaggctcgccccgaggattgacggtcgaaaactgacggatacggttctgctgtcaatctcaagaccgaaccgctcatacgaacatcacagtatgagcggtttcccatatctggagacgtgcaatagtcccatcaatatctagaagccattggaatggtagcgttcacagaaacaatgtgagatagctcactcccaatttcagcttttctcaagcaagtgccaactacactgttgaaccaagggttccgtgaagatgcgaaacctacaaccccatttaaggagtgacatgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggccctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgctgctgcgccaagatctccatcgacacctcggccatccagtacgagtccgacaaggagattcgcagccactggggcgacgacgcggccatcgcatgctgcgtgtccccgatgcgtgtcggcaagcagatgcagttcttcgccgcccgcgtgaactccgccaaggccctgctgtacgccatcaacggcggccgcgacgagatgaccggcatgcaggtcatcgacaagggcgtgattgagccgattaccccggagaccgacggcaccctggactacgagaaggtcaagaacaactacgagaaggctctcgagtggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgacgacgacctgatcgtcggctaccgcaccgagggcgagttcccggtctacggcaacgacgacgaccgcgccgacgacatcgccaagtgggtcgtctccacggtcatgggccaggtcaagaggctcccggtctaccgcggcgccgtcccgacccagtccatcctgacgatcacctccaacgtcgagtacggcaagaacaccggttccttcccgtccggccacgccaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggcctgggccgcgacgaggacgagcgcatcggcaacctggtcggcatcctggacgccggcaacggccacggcctctaccacgcgaacatcaacgttctgcgcaaggagaccatggaggacgccgtggagcaccccgaaaagtacccgcacctgaccgtgcgtgtctccggctacgcggtgaacttcgtcaagctcaccaaggagcagcagctcgacgtcatctcccgtaccttccaccagggtgccgtcgtcgactgatgaccaaccccgcgaaccgcggcaatgactaactgaaggggtggggcacggctccaccccttccttatttcccacagactttcgcatcatttggaacaggaggacaacgatgcccgcaacacccacgttccgcaccacgaccaggcatatgctcaaggaatcgaagacctatgcctcgcagactttgatgggcggcctttccggctttgaatccccaatcggactcgaccgacgtgaccgcctttccgccctgaaatccggcgatatcggcttcgtccactcttgggacatcaacacctccgtggacggaccgggcacccgcatgaccgtgttcatgtccggctgcccgttgcgctgccagtactgccagaacccggacacttggaagatgcgcgacggcaagcccgtctaccttgacgccatgatcaagaaggtcgatcgttacaaggacctgttcaaggccacgcatggcggtatcaccttctccggcggcgaatccatgatgcagcccgccttcgtctcgcgtgtgttccatgccgccaaggagatgggcgtgcacacctgcctcgacacgtccggcttcctcaacacgagctacaccgacgagatgctcgaggacatcgacctgtgtctgctcgacgtcaaatccggcgacgaggagacctatcacaaggtcaccggcggcaccttgcagcccaccatcgattttggccagcgactggccaaggccggcaagaagatctgggtgcgatttgtgctcgtgccgggcctgaccgactccgaagagaacgtcgaaaacgtggcgaagatctgcgagtccttcggcgatgccgtcgaacacatcgacgtgctgggattccaccagcttggccgcccgaagtggcacgaactgcgcatcccatacccgctggagaaccagaagggacccaacgccgccacccgcgaacgggtggccaaccagttcaaggaccacggcttcaccgtgtattaaattgcagggccgaaccgcgcgtaaataccacgattcggcccgttcgcccataccctagagatatggccgacatctacgcatttcctacgggagagtccaacgacggacgccccgtgcgccctcagggtgtgccggatgaagtatgggcagccgtcgaatccgtcagcaccatgaagcgcatccatgacgtgcgctatcgggagattcccgtgccttccaccttggccgattatggtatcggcgtggaattcgaagcgggagagcgtgccctcggcgatgccttttccgccggtcttggcagcgatgccgaatcacgaatcgccacaggctggatcatgatgctttatgctcatgagctgcgcattgactgggattccaactggcgttgcgtggcgttcgcgcgactgccgctggaaaccgccgaaaacgattctctgacccccggcatgtactgggatgacatgtgcgactatttcgacggcatcgagccggattcggtatccggcacagtcaccgtgacccaaaacacggcttttggctcgatggccggctccaccagcgccgggtgtgagattcgcgtctcatggaccccgcttgacgggaccgggccggacggtactatggacgccggcgcacaagtccgctcgtgggccgcattcatcagatccaccatccgttttgaggaggatgacgccagttgagtgacgtccgtgacaccgaaccccgactgctgaaagagcctcgcgggggagtacccgatgtcacttcgacgctggacggctatcatcgtgtctgcgatgcgctggccgaggcgacgggctcgctggccgccgacgccgaacgggcgtccggcttccgctatggacacgaggattggctgattcagttcaaacgtgagggtgcaggcatcgccttgcttgatcccgtcgccctgacccgggccggagctgattggaatgaattcaatgacgccgtgggcgacgccacgtggattctgcatgattctctgatggacttgcccggattcgccgaaatcgggctcaaacccaaagccctgttcgacacggaaatagcggcgcgattgctcggcctgcaccgctttggtctggccgccgtcaccgaacactacctcggcatcacgctagccaaagagcattccgccgccgattggtcctaccgtccgctgccgcgcgactggcgcaactatgcggcgctcgacgtggaggtgcttatcgaacttgaaaccatgatgcgtcgtgacctgaaagccgcaggcaaggacgagtgggccgctgaagagttttctcacgctttggttgcgggccttgccccgcgcaaaccgcatccgattccttggctgcgtatctcgcgcatcacccagctgagtcgtgatccaaggggcttggccatcgccaaatccctatgggaggagcgcgaccgactcgcccggcaatacgatattgcgcccagcctgttattggccgattcatcaatcatcgaggcggcgaccaacaagccgcacaatgctgcccaattccgcgcgctccgatccctgaacgagcgtgtgcgcatccataccggcaccgagcaggacaaaatgttcgagcggtacgcgccgattcagcgtgcggtcaaaccgaaggtctggaagcaggccatcgatcgagccatagccctgaagcccacccaatggcctaccatgcccgcccccgaacaggatgaaaacggtgtggtgaacgcgccccgatccatgcggctgtggcaacagcgccatccggagcgttatgaccgtctgcaacgggtgcggcgtgtgatcaaccgcatcgccgaagacacccgcacgccggccgagatgatcatcaagccacagatcctacgcaatctgtgctgggtggaagacccggtggaagtggacgtcgagacgttcctgatcgagcagggcgcaaggaactggcaagtgaaactcattgcaccgtccgtaagtggcgttatcatgtagaggttgccttacggcagaactgtaagaaataacgacttttgaggagtcattagcgtgaagatcagcgttcgtaacctcgagcccaccaaggtgaagctcaccgtcactgttgaaccggaagagctcaacccgtatctggatgcggcccgtaaggaaatcgccaagcaggtgaacgttcccggcttccgtaagggccacgttcccggcaagatcatcgaccagcgcatcggtttcgccgccgtcgccggtgaggccgtgaacgacgcggtcccggagctgtactccaaggccctggaagagaagaagattcgtccgatggctcagccggagttcgacgtgcaggatgttccgcagtccgccaacgacgagaccaagctgaagttcaccgccaccgtcgagcgtcgtcctgacatcgaactgccggaaatcgacggtcttgagatcgccatctccaagccggaagtcaaggatgaggacgtcgacaagcgcctcgaggccctgcgtcagcgcttcggcaccttggtcggcgtggatcgcccggccgccaagggcgacttcgccaacatcgacctgactgctgagattgacggcgagaccgtcgactcccaggaaggcgtgagctacgagctcggctccaacaccatgctcgacggtctggacgaggcccttgacggcctgtccgccggcgaggagaccaccttcgaaggcacgctggaagccggcgagcacgagggccagaaggccaccgtgaaggtcaaggtcaactccgtcaaggctgaggaactgccggagctgaacgatgagttcgcttccgaagcttccgagttcgacactctggacgagctcaaggctgacatccgcaaggctgccgctcaggacgccgaaggtcgtcaggccaccgaggctcgcgatgccttcatcgccaagctgcaggaaggcctcgagatcccggtgccgaagggcgtcaaggccaacatggtcgaagagcagctcaagggcatgaccccggacccggagaaggccaccaaggagcagaaggctcaggccgaggagaccgtggagaaggatctgcgcgatcagatggtgctcgacgctctggccgagaagctggacgttcaggtgtcccagtccgacgtgttcaacttcctcgcttccatcgcccagcagtacggcatggacccgaacaacttcatccaggccatcatcaagaatggccagcttggctccgctgtgcaggaagtcggccgttccaagggcctgctcgccggcatgcgcgccgtcaagttcaccgctgatggcgaggttgtggacctctccgccttcctgggcgaggccgctgaggacgaagagtccgagtccgtcgaggccgcttccgctgctgccgccgtggccgacgaactgtccgccaaggatgacgccaaggatgctgagtgagcatagcctcatcgcgttagcgtgattgtttgagcccggaatcgtgtttcacggttccgggctcttcctattctggtaaaaggactatttctttggctcccctctttgaggggagctgtcgagcgtggcgagactgaggggagttcccaaggcatactcgttgcatagggtgcggaggttgacatgcagccaacggttactatcaaacgccttggttggctcgctgcggcgaccattgtgctcggcgtgctcatcggtgtgggagcaggtctgctgaccctgttgctctacggcgttgaacatgtgctgctcggctacatcgaaggcccagaattgtctggtccattcggcgtgcccgctgcacgccgtgcgatatcggtgaccgtgggactcagcatcgcaggcattatctggtatctgctgcgacacaaaacaactgcggtgccctcagtcaagaaggccgtggcgggaaagcgaatgcctttctggcaaaccattgtgcatgtggtattgcagattttcatcgtcggctccggtgcctcgatcggccgagaagtcgccccacgcgaactcggcgccatgctcgcgcaacgtttctgcgacctgttccatatcgagggcgttgacggcatcgaccggcgcatggtggtggcagtggctgccggtgctggtctaggaggcgtctatgacgcgccactggccggcatgttcttcgccgtcgaaatcctgttggtagatgtgacaatcgaaaaagttgcgtttggactgggcatgtctgccattgccgcattcgtggcggttgcgatcaaagggcatcacctgttctacgacattaccgccatgcaaccggaatccacgccaacgttaatggtgttcgctctgatctgcggtgcggcatgtggagtgggcggcgcattgttccgaaaaggttcgcaatgggcggaagcgcacaagccaaccggtaaggctattctgtggcagatgccgctggctggtctcatcaccggtttggtggcgactgttgtgccgcaggtgatgggcaacggccgtgccgcagcgcaacttggattcagcacattcattcctgaaaccgccggcactgctggtgccatgcagtcggcatcttcagcggccgcctctccatggaacttgctgacgggcggcggtaatgtatccgattcggcctctggcgggggagcgggctctggaatggcatcgttctgggccatgcttcagggtgggagcggcccttctggatccgtgatgaacgccggtttcccgctgtcccagtccaatatctggatgttgctgggtgtgttggcactcacctttgttgccaaagcgctggtgacgctgatgaccattcgctccggtgcgtcgggcggtgtgctgcagcccggcatcgcattaggttccacgctgggtgcgatgctcgggctcgtatggatactgatgtttccgaccgattcgataaccgcgtgtgccttgatcggtgcggcttcgttgctttcggcctcacagcaggcaccgcttatggccatgtgcttggtgatggagctctctgaagcgccgattaccttctttgtgccggtcggcatggccgtggccacgtcgtcactgatatcaaagtggttgctgagtcgtaagtaaatacatatattctggctcccctctctgaggggagctgccccggtcgaaactcccctcagccgcctatggcgacagctcccctcagagaggggagccgaggtaaagaaagctatgtcagaaaatacagaaattcgctcggcacttgaattgcttgccgctgagccgctcactgagcagattgactactatcgaaagccattcatggtgttatgggccgccattcaggaggcagccagcgatgtggccgaagactacgacttacctgcggatatggcccaattatgggtggctgaacagatgcgccaagtcgccgattcactggtcgatcggctcgcggaaaaagccgtggcccatggtgccagcaagtccaacgtagcgcgagccgccggtgccagccccgccaatgccgcccgtcgcttcccgcgtctgggcgacgatgccgcctcccagacccgcctcctcattgacgacgtcctcgacaccctcgaataaaccgaaatccctacgctacccgccaaaaagcacgcgaaaagacgccttcagtcgcttcaaggcggtagtctgaacaatgttcgagtaattagaaggagaatcaaggtgagcaatacctttgcgaccttgccggtcatggcgggcgatgacgtcccggccggccccgtcgacccgattttcaaccgtctgctcaaagaccgcatcatctggatgggtgaagaggtcaaggacgatatggccaaccgcatctgcgctcagctgctgatgctggccgccgaagacccgaagaaggacatctggctgtacatcaactcgccgggcggctccatcaccgccggcatggccatctacgacaccatgcagctcatcgagcctgacgtggcgaccgtgggcctgggcatgtgtgcttccatgggccagttcctgctgagctccggtaccaagggcaagcgttacctgacctcgcacgcccgtgtgctcatgcaccagccttccggcggcatcggcggcactgccactgacgtgcgcatcaacgccgagctcatcatggacatgaagaagaccatgagcgagctgaccgctgagcagaccggccacaccctcgaggaaatctaccgcgacaacgaatacgaccactggttcaccgcccaggaagccctcgactatggcttcgtggacaagctcgtgaccacgccggacaccatcggcaacaaccagcagggggagtgagactcatggcaagtgaagaagcaaagttcgccgcccgtgccgaccgcttggccggccgtcagggcgtagccggtttcatgccggcctccgcccgcgcagtccagcccgcgccgaccaaccgttacatcatgccgcagttcgtggagaagaccccgtatggcatgaagacccaggacgcctactctcgcctgttcgaggatcgcatcatcttcctcggcgtgcaggtggacgacgcctccgccgacgacgtgatggcccagctgctggtcctcgaatcccaagatccgaaccgtgacgtgatgatgtacatcaactcacccggcggttcgatgacggccatgaccgccatctacgacaccatgcagtacatcaagcccgacgtgcagaccgtgtgcctcggccaggccgcctccgccgccgccattctgctggcctccggcaccaagggcaagcgcctgatgctgccgaacgcccgtgtgctcatccaccagccggccatcgaccaaggcttcggcaaggccacggagatcgagattcaggccaaggaaatgctgcgtatgcgtgaatggctggaggaaaccctcgccaagcacaccggccaggacgtcgagaagattcgccgcgacatcgaagtggacactttcctgaccgctcctgaagccaaggaatacggcatcgtggacgaggtgttggaacaccgccagtaaaacttccggacattgcaataccctcggtcggcaacgaccgggggtattgtatttcaaggatgacaatgataatgcgcagcgtggcggttcgacggtgcggcgcagtcggcaaaggagaatcatgggacgtgtggtgagctacaacgaggacgtaccccgttgcacgttctgcggcaaaaccgaacatcaggtacgaaaactggtggccggtcccaacgcctccatctgcgatgaatgcatcgccctgtgcgtggacatcatctccgaggagcgtgtcaaagatgccgaggtcaattcgctgagcctgcccaagcccgctcagatcttcgattatctcaaccgctacgtcatcggtcaggagaacgccaagcgcgcattatccgtagccgtatacaaccattacaagcgcgtcaacatggagcttcaggagtccgctgagcagcttgacgggaataacgggcacagtggccagaccggcaaacaagccaagcaatccgttcccacccagacgcgtgctgcccgccgcagcaatgaccctttggctgacgtcgaggtcgccaagtcaaacattctgttgctcggccccaccggcgtgggcaaaacctatcttgcgcaggcgttggcccgcgtaatgaacgtgccgttcgtcatcaccgacgccaccaccctgaccgaagccggctatgtaggcgacgatgtggaaaccgtgctccaacgtctcctccaagctgcggatggcgacgtaagccgagcccagcacggcatcatctacattgacgaaatcgataagatcgcccgcaaatccggtgagaacacctccatcacccgtgacgtgtccggtgagggcgttcagcaggcgttgctgaagatcttggaaggaaccatcgcctccgtgccgttggaaggcacgcgcaagcataaggagcaggacgttgcgcagatggacacacgcggcatcctattcatctgcggcggtgcgttcgtggggctgacggacattgttcgcaagcgattaggccgtcgagagaccggcttcggcgcgaattggcacgacgccgacatgaaagacgaggaattgctcgaacaggtcaatgccgatgatctggccgagttcggactgttgcctgagttcatcggacgtttgccggtcaccagtgtgctgaaggaacttaccgtagacgatctgacggcgattctcacccagccagccaacgcgctgatcaagcagtaccgtaaactgttcgccgtcgacggcgtcgatctgcaattcacagaacaggccattcgggcgactgctgatatcgctatcaagcaggggaccggcgcacgcggtttgcgttcgattatcgaacgtacgttgcaggacacgatgttccagttgccgagtttggatgatgtgaggcaggtgattgtggacaaggcgtccgtagagggttccagcacgcccaaactcctgcgcgaagccgtggatgtgccgcagggacgtctcaaagttgcgcagtcggttttgcttgaccgagtccgtacacacgaggcgtgaggccagtaaatacgccgttgcggtagtggtcgggatggtgcgactcgccgcaacacgccgagttgcattcagctgaacggcgtgtattatatatcgagttgtctgaaagacaacatgcgccagtagcccagcggattagagcagctgactacggatcagcaggtcgcagacccccgaccctctccatgccatggagatgcgctaccagctgcgctatagccccgctttcaattgttggcccgttgtttggacctcgtatacattacgacgagatgtcgattctggcaaaagccggcgtgtcgccaaatggcaaaagtgggatttggcgacactttttggcttgtctccgccattattcaggcattgggttattcaattactgcttgaacggtttttcgaatacactgaacctgttggctcagcaggggagccgtgacacgatcagcgttcgcgttcccactcgtcggtgtcggcgatggccggaccgtgattgtagtccagcagacgccagcgcacagtgccatcgggattgtccatcggcaccaagcgcacccagtgcgcattacgcaatgaaaccaccgtagaaaaggtcggatcgatcgcggaaatgcccaacagggtctgcaatgtctgcgcaatccatgcgccgtgcgagaacacgaacaggtccgtgtcgtctccggcacgcgtggaccagtcctcaagagcctccacaccgcgtttgcctacggcttccttgggttcggcaccatacttcagttcaccgccccgagactccatccaggaacggaagtcctcagggtagcgttcggccagttcagccacggcatggccatcccaatcaccgaagctgcgttcacggacgcgacgatcatcgacgggctcgattccacccaatacgtcggcgaaagcctgcgcggtggcgtgcgcacgcttcaaatcggagcagacaatgaaccggtggttgatttcctgccgacgatcgacgtacagccttttcaaggccgcggcggtctgcttgacctgccattcacccacggcgtccagcggaatgtcgacctggccttggagcttgtgagcggcgttataggaagtgcgtccatgacggataaggaaaacggaacgaacatgattggccatagtgacgatcctttcgattccagtgaggaaacaggaaaaagggagggctgcctggtgccgtcaatgacgttcggcaacaggcagcccgacacgcgaatatcagcgaatatcagcgaatatcagcaagtatcagcgttacgcgattcgcacgttacgcggtggtgacggcagcatcttccgcatgctccgccgtttccgggtgtgcgagttcaagatcgatggccgggcagtcgcgccagagtcgttcgagcccgtagaattcgcgcgattcctcgtgcatgacatgaaccacgaaatcaccgtagtcaagcagcacccactggccctcggtcaggccctcgcgcgagcgtggctggcggccggagcacttaaggaacaggtccttttcgatttcctcggccacggccagcacctggcgctcgttggaggcgccggcgatcatcatgatgtcggtgatgccgagcaggtcggctacgtcgaaggccacgatgtcggtggctttgatacggtccgcggcctcggcggccacgcggacggcgttgatggaatcctgaagtgcgggcatggttcagcgctcccaggcgggcttccagccctcgacgttgtgttgcgtattctcggagtagaccatcgtgtcgctcggcacggcgtggcgcaccacggaaccggcgccggtggtcacattgtcgcccacttcaaccggggccacgaacaggttgccggcacccacgtggcagccggagccgatggtggtgctgttcttgtgcacgccgtcatagttggcggtaatggtgccgccgccgatgttggtgtggtcgccgagctgggcgtcgcccacgtagctcaggtgcggcaccttggtgccgttgccgatgtgcgccttcttcatttcgacgaacgcgccggccttggcatcctcgccgaactcgttgcccgggcgcaggtaggtccacgggccgatgttcgtgcgtgcgccgatgtgcgattcctgtacgcgggaacgctcgaccacggcaccttcgtccacggtcgcgtcgatcagggtggtgtacgggccgacgatggcgtcctcgccgaccaccgtgtggccttgcaggaaggagccgggcaggatggtggcgtcgcggccgatctggacatcgtcctcgatccaagtggtttccgggtcaagaatggtcacgccgtcgcgcatccagcgctcgcagacgcggcggttgtaggtcttggacagcgcggccagctgcacgcggtcgttcacgccttcgacggtgagcggatccggagcagcgaacgcgccgactttgccagcggccttggcggtttccagcgcgtcggtcagatagaactcaccctgcgcgttgttcgacttcagtccggcgattgcctcggtaagcacggaagcctcgaacacgtagactgaggtgttcacttcctgcacggcgagttcgctgcggttggcgtctttctgctcgacgatgcgcagcacgttgccttcgcgatcgcggatgatgcggccgtagccggtcgggtcatcgaggatggtggtgagcacagtggcgccgttgccggaggcggtgtggaattcgaccagacggtgcagcgtctcgctgtcgagcagcggcatgtcggaggcggcgatcagcaccgggccatcgaccttgccagcctcggtgagctgcgccattgcgcactgcacggcgcggccggtaccgggaatgtcgtcctggttcacaatggtgacctgctcgtcataggagcgggcggcttcggcgacgcgctcggcctggaagtgcacgaccacggccagcgtgtcgggattcagggcggccaccgaatccatgaccctgttcaggaaggtcttgcctgcaaaagcatgcagcaccttcggcttgttggaacgcatgcgggtaccctcgccggctgcgaggacgatggctgcggataatgccataactgacgtattcccttcgatcggaatgtctattgagggtggaaacacctcaaaacaatagacggccgcccggatgtcgagcggccgtcagccgttcccccacctggactcgaaccaagacaaagggttccaaagacccgtgtgctgccattacaccatgggggagtcgtgggctttcggcccacaagtgttcatttataccatattgtcggtatttaccgaaagactacgccatgtcgcgtctcgcatcgtgtgctttccacgaacaaacacgcacgtgatcaggcgaacaggaagccttgaccgtggtgctcggggtaggtgtcgaacagttcggcgaccgagccgtcctcgaatacggcgcggatggcgctggccagcagcggggcgatcgacaggacggtcaagccatcccagcgcttttcctcgggaatcggcacggtgtcggtcagcacgacctcgcgcgcaccgcagttcttgagtcgctcgacggccgggccggagagcacgccatgcgtggcgaccacggtcaccgacttggctcccgcgtcctgcagcacgtggcatgcgcccgcgatggtaccggcggtgtcgatcaggtcatcgacaagcacgcagtccttgccggcaacgtcgccgaccacacggttggcgaccgcctggttcgggcgggtgatgtcgcgcgtcttgtgcacgaaagcgagcggaccgccgccgagacgctgcgcccactgctcggccacgcgaatgcggccggcgtcgggggagacgacggcgacgttgtcgagatggccctggaaacgatcacggatgtagtcgaccagcactggcatggccaccagatgatcgaccgggccgtcgaagaagccttgggactgcgcggcatgcagatcgaccgacatgatgcggtcggcaccggcggtcttcagcaggtcgaacaccagacggcaggagatgggctcgcggccgcggtgcttcttgtcctgacgggagtagccgagcaacgggcagaccgcagtaatggaacgggccgaggcgcgcttcaatgcgtcgatcatgatgagctgctccatgatcgccttgttgatgggcttgtagtggctttgcagcacgaacacatcggcgccacgcaccgattcagtgtagcgcacgtacatctcgccgttggcgaaatcgtatgcggtggtttcaaggacgtcgatgccgagctgctcggcgacatcctcagccaacttcggatgaatccttcccgtaacgagaataagattcttatcgggctttccttcaaggattgcgctcaccatgtctcccaacgtgtggtctcgttgatgcagtcttcagcatagccgttcttcacgaccggttggacaactcagcgttgcctgccgttcacctgccgcttgcgatccattgttcgatggtctgtctgaccgcctttgcatagatatcgctatccatgctcgggtggatgccgtcggagccgagcacctgcgcgttcgcgttggctgtggcatcccaatccaccagcaccacattgtccggatgtgcggccgcatagtcggcaagcacctggttggtaggtggaatccacgtacggtctccgtgggcattgaccagtaccagcacgcggtcggggccgatcatattacgaatctggtccaactgatcgggggtgattgccgaattggtgccaaggccgatcaacacccactgccgcagactgccggcggacagagcgttgccgatgagttcgggggcgaccatgatggagcgggaaacgctcgcgtcggtctgaatgccggggaagacttccgaaaggccctgtgatgaggccagcatcaccgaatcgcctatggcggtaatctgatcgccggtgggcatctcatgcttgggcttgggcggtgccggcacggcatggcgcagcagcacgtgttcggttttctgcatacgttccagttgtgcggcctgttgctccagctggatctgcatggcggttttcgcaggtgcatgagcaatgccctgcacgcagccggccaacgacagcaccaggataacgtcaacggcaataacccgggccacatgattcttcttgttcgtgcgaaggggcaccacgacggataccgccgagtgcgttgccgccggtttctccaccatcagccaggaaatcatcaccgcaatggcggtgagcaacgcggtcatgatgagaggccaaggccctactgccttgaagatcttcggggcaagggcgctggaaagaatccacaacggccagtgccacaggtagatgccgtacgaatacttgccgagggaggccaatggcttgaacaccatgaggctttgcatccaggaatcgtcggagatggtaccggcaatcagcagcacggacaacaagctggacaatatgatgccaccgcggaaggcgaatgcatcctgtttgccgataaccgccatggtgaccaaggcaatcaggctgaggaacgccaataccggtgccgccgcattccagatgcgatgctccacgggaatctgaggtaacggagcccgatgtgcggctgccgaagcgctcgagctaatggtgcggggcatcggcacagccctctggcgagcgtggcccaactgaggagcggtgacccaccaggcgagagccacacccagcatcaggcccatgctgtgggtatcggtgccgaagtagacgcgggtggggtcgcctttgggcacatacatcacccacatggcgatactgctgaacgccgcgagtcccagtgggatgagtgaagacagtttcgtctggcggagcttccacatcagccagacgatgaacggcacgatgacgtagaactgcatgagcacgccaatgaaccacagatggcgaaacacctgcgggttcatttggtcgaaatagctttggcctccggcaatggcgtaccagttgtagcagcccagcagcacggtgatgacttggtcgcggatggaaactagaatgtcgtgatcgaacagccagccgacggagacgatgaccggaatcagcagaaacagcgccggatagagacgtactgcacgcttgggaatatatcgcacgagattcagcgatccggttttcgccagagaacgaatcaaactgacggcaatcaggaatccagagacggtgaagaacacgtcgactccgtagaatccgcctggcagccgttgctgcatgcagtggtacagcacaatggctatcagcgccagtcctttaataccgtctaaacccacgaaccgcttcacggataatccttctctctccgtagtgccgatggcattccccgttctctccaacaaacggaaaacaagcccagcatggccgaggggagagacaatgcgacagcagcgaatcgtcaggccgcatgctgcatgattaccggcttgacgattcgcggcataccgcgcttatcggtggcgcttaccggtgatacagactcacccgttcgtacttcggttcgcagcacacgttgatgccgagtttgcgatacagcgcctcgtccgtggatgagatgataacggagaagaaggcgtcgcagccctgcaactgtttgagcccgtcgatgacgcgagcggccacaggactggtggcgctggtgattgacaatgcactcagcgtttcatccgagtgcaagcgtcggttcacgctgttgagatgttggcggcttgcagttcgatgtatttttcgttgtcgaatccctggcgcaaagaggtcggcatccctttccggacgacgtcgtaagcggaaaaattataccgggcatcgtcggcaacaaaaaagggattccccgatggagaatcccattcgtcacagagagcaattactcccattcaattgtggccggaggcttgctcgtgcaatcgagaacgacgcggttgatctgtcggcattcgttggtgatgcgcgtggagatcgtggcgagcacgtcgtagggcacgcgagaccagtcggcggtcatggcgtcctccgaactcaccggacgcagcacgatgggggagccgtaggtgcgctcgtcgccttggacgccaaccgagtgaacgtcggcgagcagcacgaccgggcactgccagatgtcacggtcgaggccggccttggagagctcctcgcgggcgatggcgtcggcctcgcgcaacaggtcgagacgctccttggtgatctcgccgatgatacggatgcccagacccgggccggggaagggctggcgccagacgatttcgtcgggcagaccgagctcggtgccgatggcgcgcacctcgtccttgaacagggtgcgcagcggttcgatgagctggaacttgatgtccttaggcaggccaccgacgttgtggtgggacttgatgttggccgcgccgtcgccgccgccggattcgacgacgtcggggtagagggtgccctgcacgaggaacttgacctccttgccgcgcgcgccggcctcttcaagcacttggcgctgggccttctcgaacgtgcggatgaacttctcgccgatgatcttgcgcttgcgctccggctcggagacgcctgcgagggcgtcgaggaagtcgtcggcggcgtcgacggtgatgaggcggatgccggtcgcggcgacgaagtcgtgcttgacctgctcgacttcgcccttgcgcagcaggccgtggtccacgaacacgcaggtgagctgggaggtgctgaaagagggctgggcagcttggtgtgttccggcattcggcggatattctatagccattgcttataagcgcgcattgacaattgcgataccgatgtgccggtgtcgcgtaccatgacttgctaagttcgggaatagagtcgagcccgccacaatagagcggcatgaggaagaaggattaatgggcgttgatttccgaacgcaagccatccacgccggctacgagccgctggataacggccgtgccgctgtgccgccaatctatgcctcggccgcattcgacctgggtgacgcggcgcgcggcgatgcgctcgcgggcggtgacatcgacggcttcgagtactcccgtgtggccaatcccactgtcgatgcactggaaaagcggcttgccgcgctggagggcggtatcggcgccgtggctgtcggctcaggcatggccgcagcatactgattggatgccgcacttttttataagaagccagcatgcacacatagtgaacagttgtacacatatgcgtacgatgtctaccgctttgttttgaacgctgatacgatggaaatcacgagtcgaggccgagggcggtttcgacgtgggtgaagggaaaacatcatggccgtattctttgctggtccgctgattatcatcgtgctactcattgttctgctgtctgccgcattatttgtcgtgccgcagcagcaggcctacatcattgagcgattcggcaagttccttaaggtccagttcgccggcatccatatccgcatcccgttcgtggaccgcatcgccatgaaaaccaacatgcgtgtcaaccagcttaacgtgcagctggaaaccaagactcttgacaacgtgttcgtcaccgtggtggcctccacccagttccgcgtgaacccgaacgatgtggccaccgcctactacgagctgcgtgacccggccggtcagctgcgctcctacatggaggacgcgctgcgttccgctatccccgcactgtctttggacgatgcctttgcccgcaaggacgatgtggcgttcgacgtgcagaagaccgtgggcgccgaaatgagccgtttcggcttcaccgtggtcaagacgctgatcaccgccatcgacccgagcccacaggtcaagaacgcgatggactccatcaatgccgcccagcgtgaaaaggaagccacccgtcagcgtgccgaggcccagcgtatccagatcgagacccaagccgccgccgatgcggagaagactcgcttgcagggtgagggccaggccaattaccgccgcgagatcgccaacggtatcgtcgaccagatcaagagtctgcaggctgtgggcatgaacatcaacgacgtgaacaacgtggtgctgttcaaccagtacctcgacgtgatgcgctcgctgtccgaatcgaacaacaccaagaccgtggtgctgcccgcctccacgcccggcggttatcaggatctctacgagcaggtcaccaaggccatgctcaccgcttccgagacgaagtaatcaccccgtttgcgaatccccatccatcgatagtgaagcccctccaagcgagggacttcactatcgctatgcctgaaggaatgccggaatggcctcggccgccgcgtatcccttgcgatacatcatttccaggccctcgaagttcttcttcagggtgttgagaccatacaggtcttcgggtgcgaggatcagcactttgccttccgcctcgtaatgcttggcgagttcgagttcgtcgttgtaggtcttgtagcgcatgcgcagcttctcggccgcggcggggtgggagcgttcgaggatgcgggccggagccaaatccttctgctgcttgcgcacttcgtcacgcaagcgggacagaatcagaatcacgcgatcgtagccgtcctccagcgccttctgcaccggcaccggatcggcgatgccgccatcgaaatacggcacgccatccaccacatacggctcgcaggccaccggcacggcggacgaagccttgatgatgtcgaaatcatcaaaacgcacgcgcgatttgtcgaagtacttggtcgagccgtcctcggcattgcaggccaccacggtgaacccggtctcattggcctcgaacgccgcgaaatccaacggattctcgccatcgtgattgctcagcgtgccgtagatgtagtcgaggttggcaaagttgtggttcttgaagaagctttccgcactcgcgtactccttgcggaaggcgtacttggtgtagaaggtgtggttgcggccgtgctggcgtgcgatgaatgaggtcatattggccgcgccggcggaaacgccgtagcacatatccacgtcgatgccgtcctccagcatgcggtccataacaccacagccgaaaatcgcgcggaacccgccgccgacatcaatcatcgccgtctttgtcataccaaccccctgttcacttgaatctggtatgagcttacgcgtgctgcacggacaacgatatgggcagtgtgctgtgaatttgtctggttcttccttggcttccctcagagaggggagccaagaacggctcatacgttcagcaatttgcgtgacaactcggcaatccgttcggacggatcggaattggcgagctccacgccgccggtcgcgtcttcgggtgccagtttgcccagggactccaacaccacgcccagatggcgcacggtaccctcattgccgtcgatgacagcagcccgttcgggcagcagctcgcggaagtagtcgcggtagaacacgaaatgcgtgcagcccagcaccaccgagtcgatatgctccatgtcgtactggtcgaagtagccgtgcagcgtgcgcatcaccaggtcatggtcgccgagccgcccggattccacgatctccaccaagtcggggcaaggctccttgaaaatcgtgttgttggaatcgaatcgatccatcagtttggcgaacttccgctcacgcaaggtcaggggagtggccgccacaatcaccctctggggaatatgatgcgggtcggaaggcacgtcaccacggtcgcacgccactttcagggccggctccatgccgatgatcggaatatcgtagtgttcgcgcaaatcgttcaccgcggcggaagtggcggtgttgcatgcgatgaccacggccttgacgccttgacgcacgaaccgttcgacaatatcgaaactcagggccctcacttgttcaggcgtcttgatgccgtacggtgcgttggccgaatcaccaaaatacagcacatgctcggccggcatatccttggcgatttggcgagccacggaaataccgccaagacccgaatcgaatacgccgattggagccgaagagctcatgcctgaatcctccctatagccatgcctgcaaccgtatgttgccgcgaccgatcacaaagccgattgttttgcggtgttgtttcgctccctagagtactctgaaagccatgagtcttccgcaacgagtaaccaagacacacgcaaccggcaatgatttcgtggtatacctcgacaagtccggcaaattcgagcctaccgccgatgaggtccgattcctgtgcgaccgtcacttcggcattggcggtgacggcctgattcgcctgacacggcctgatttcgtgtctgatttaagcgatgatcagctttcggacgtactggccgggggcacgaaatggttcatggactatcgcaatgcggatggatcgttggcggagatgtgcggcaacggtacacgcgccatcaccttgttcgctcagcgtgagggtgtggccgactccaccgagccgttccgcctcggcacccgtgccggcgtcaagattctgacgccacgcggcaatatgaggccgtacggagccaacgtgttccaggtcgaaatgggggagtggaagatcggcgaaaccgacgcctacgaggtcaccatccccggcactgagggctcggcgcgcggtacgttcgtggatatgggcaacccgcatgtggtcgcggtgatcgaggatgccttcgcgtccctgccagtggttgaatcactggatttggtcaccaaaccagtggtggctccggtcatcgaatccgaccagaacgtggaattcgtgcgggtcgacgacatcgaccagaacaccggcgtgggtgaagccacgatgcgcgtcaacgaacgtggctgcggcgaaaccctgtcctgcggcaccggcctgtgcgccacaggcattgtgctgcgggccaagaccggcatcagccactgggacatcaccgtacgtggcggtaccctgcgcgtggacgtcaccgacagcgacgtaaagctgaccggagcagccacgctggtcgccgatatcgatttgttgtaaaggaatcaggcagcgaacagggccgcgccttcggtgacgatgatgagtaccacgatcgccacgatccacagtatatcgaccatgaggtcgatgttgaggcggtaatacttattgagtccggccggcaccattgcgacctcagcctcaccgtcgctatcatcagccgccacagctttacgtgacggcaatccctgcacggccacggtcgcatggctcaacgccatgaactggatggtggtggagaacatcagggtcaggcaccacgggcacagcgcgtgaatcacgaacagcgactgcgtgctcagccagtacgagtaagccaaagcggccagtccgcccagccacgtgcaggtcgcgaaccaacgcggcaccttcacacgcgccagaccgatcaccgcgatggtaacgaacaccgattcggcggcgatgccgaagaacgcgttcggatagctcagcccgccgaatttcacgatttccgcctgccaggactgggccaccgccgaacaggacaccgccgagttcagatcgcagccgagcgcggactccggatgccgagccaattgcaaagtctcagcggacagaatgagcgaggcccccaacgccactgccgaggcaatcagcatgatgagatatgtccaagtggcactgtggcgccatccaatcaacggtcgtgcctccgccaagccaagcggcgtggtgttcgtggtgctggatgatgtgtcggttgcggtgttacgagtcatcatgtccctttcgatagcgctgcgctccagattagcctctgcggttgtcagctgggtgccgaatgtctggtttcggccgttggcagaaggtgacgacctgtctgcgccttgcgtgggaatgctgaaatgaggttacgatggaaggtatgactggatatgtgatgcctttggaaccgcccgccgtcgggtgggacatccactgccataccgccttctcggatggcacggaaacgccggccacgttggccgaacaatccaaggcattgggactcaagggcgtggccatttccgatcatgacaccaccgccggctggccggaggccgaagccgcggctcatagggtcggtttgccgttgctccgcggcaccgagatcaccgccacggatgagaacgtctccgtgcacatgctcggctaccagtatgatcccacgaatcagcacatcacggacttgttcgccaatactcgagccgcacggttgcaacgcacgcagcgcatggtcgaattgttgtctcgtgattatccgattacctggcaatccgtgctcgcccaagtcaaggagggtggcaaaaccaccattggccggcctcacatcgctgatgctttggtgagtgccggcgtatatcggactcgttcggaagcgtttgcggatgcggtcagcgcctcatccaaatactatattcccacgccttcgccgacctctcatgaagtggtggccgccgtcaagggagcaggcggtgtgattctgatcgcccatgccggtgatgtgagccgtaaccgcagactgttgtccgatgaccagatcgaggcattgatcagcgaaggactggacgggctggaggtatggcaccgtggcaattcaccggagcaacgagaacggctgctcaccatctgccgccggcaccagctgctggtcaccggtgggtctgactggcatggcaaaggcaaaccgaacaaactgggggagaacctcaccgacgaggccactgtcgaagagatcgttcatcgcggcgtgcttccgctatatcggtgattcagcaatacaaaagcggccttgagataatgcccaaggccgcttatgcgcgattcatggtcacagcgtgccgaagccgacggcgtgcttggtttcggagccgatgatcgcgtaaccgagtgccttggcgggcacgatgatgcgacggcccttgtcatcggtcagatcgatcgtcgtgttgtcggccacggcctgcgcgatggcctggctcacattgtcggctgattcgtcggtgctgaagttcaccggtcgtgccacgttctgaatgcccagttcgatatccatataaggctccttgttctgccgtctttgtgacgaacatcatggtaagtggccgtcgccggccgaggttctgtactctattgtgccgcgtgtctgcgtcgtcatgtgcggtgttacgcgctcggcgtggcgcggaacaccgtacacgacattatttggatgatgtggacgattcggccagcggattgccctcgctgtcatacccgtccaacccggcacgggcatcgcgcagagcgcgttcttcccgctccaacagcggaatcaccgtggtttgggcactcgaggctccgtactgaacgagactgtccggagtatcgtcattcaccgcatcgtcggtcggggcggcggattgagacgcaggggaagcgtcggttgacgtcgtgccgctatgcccgttcatactgaggagctccttcagcgtgatcgtcaccgaagaatgggaagcgccatgtgagggctgcggtttggtcgatcccgtaccggttgcgatgccggagacattcgcttgcgggtgattggcggtccggtcagcatcgggttcgacttccggggtaagatccacgtcgccagcggccacgatgtcagcggaaccggtgcgatcgggatcgggcgtgtcgtccgagacctcggccgccgcggtaccggtgtcggactgctgcggttgtgcgggtgcctgatgacggtcgtcctgcaacaatgtgccgacggtgattgtggaagacctggccgccgagcatgttgaccagtgaggcgtagtcgggcttcagatcgccggggatgatcgcgttcatgcccagggcgctcagtcccagcacctcgcggcgcacgaacgtgctcttgccgatggccggcaggccgagcaggaacatagagggctgtttgatgatgccggccttgaaccagctgatcgggtcgcagcacacgccggcacccgtcatcaggcttcgcccgaccggcaccccctcggccggcagggccatgtcggtgccgaacggccagaacccgccgcacacctggttcgacgtgccgaagaactcgtctatcgtgggcatcagggccgcatagccgcctccacgcgagcgtttcccccgccacggcatcgggggcacgggctcgtccggtttggccttcaacggaccgagcagcatggattccatgcgtgccacggggtccgtggccgtggcgcttggcatggttcccttccgtttcgacggcttccatggcatcggcatcatgtgtcctccgttcaggacaggagccggccgagggggccggctggagtgtatgatctgacgttcaatccaaggggcaggcttgcggcgaatcccgtgtcctgtgccccgtagcaggggcgcaggtcgatcttcgcgccgcctgcggcctgttccacggcgcgtgacgcggcttcgagtcgttggctttcctgttcgcccctggacacggtgacggtgacgagcatcccgaagaacaccatgaccgcaccctggttcgtttcgacggcctggcggttggccttgcctatctggctcatggacctcaccgtggcgcgtttctcctggctgacctggttggctgccttctgccggttctgttcggccatgaacatggtcttgtcgggcggcagcatccggtagagcacggtgacgcgcttgcggtcgcagtccgccaatgggctgagcagtcgggtgagcgtgtcggcggtcacgttgctttgcggcgggtccaccatctcccatgtgcggctcagcccggaatcgtgcgaataatggctccagccggcctcgtgcatgagcggcccgcaatcctcccatgcgatgtacgggggctcgtcggattcctcgatggtctcctgcgcggccggatcgtaggcgacgcggaccatgcgagtgatctcctccatgcccagggccctcgcggcaccgcctcccgcctgcgctatctgctcgcggatcgagggcagcagcaggcttatgcgacgcgcggcctccccggcctccaggtatttgccgtcacggtcggtgtagcggaaagtcaaggtgagcgtcacgtcgttggaagcgccgccggctgcgtactggtccatgatctgcgccatggcgcgcgccgcgagctcgggagcgtcctccacgatgcgtctgctcagcgtgcggcggaaacgcacgccggaatcgggtgccgtgtccacggtcacggccagttgggtgacgccggtctcggaggcgagcgattccatgagcccggcccacgaggccacgtacgagtcctccacgtcgtcgtcggcgaggttcgcgccctgcggctggcatgacaggagcagcgagtattcgccggtgtgcgaatgccgcaccaagcagaactcgccgcccagcccgtccagggcggaggtcaggcccacccgtgagaggatgcccggcagcatggccttgccgccgtcgatcggcgcgagcaggccggaacggtacaggtttgcgccggtacgctgcgcggccatccacgtgcgtttctccacggcgcgatccaccatgttgcggtgctcgcggtccctgatcgccagcacgaggatgacgcccatgccgaccacgaggatcgcgatggccgcgaccacgctcgccatgctgaccagcagcgtgcaggtcagcactcccatgcccgctatcgtcagcgggatgccgatgttgcggatgcctcccggcatcggccgcatccaatcgccgtatgtcgtgttcgacgccatggctatccgaatctccttaacaaaacgtatgcgtcagaatgtcttgcccttgcgagtggccgagcgatcggcaccgtccggtgcgccctcgcgggcgaacccgccggcatcgccgttcgccccctgcggcctgttgccgcctgacgggtcgggtgatgcgccatcgggtgccggcggaaccgggctccccgcaccattgccgttcgctccctgcggcttgccgtcgctgcccttgcggttcgctccctgcggctggtcgccggtgttctgtggttcgtcgcccgtgggattgccgtccagcggcttggcttgcttgccgccgccgttcgctccctgcggctttccgccgtttcggccgagtccggaaagcagtccggccaggccgcgaccggcaccgggtttggcaccgtccggtgacgcttcgccgcgtccgtcgccgccgcctttcctgccgcccttgccgcccatggccttgcgcaggccgccgccggccacggcgactcccatgccgagtatggagggcaggattccgccgccgccaccgccgaccgaggattgcacggcgggcacgatcacgcggatcatggcgggaaggaggatgatgacgctcagggtgagcatcagcgtgatggcctggctgtcgtcgccggggccggccgtggccatgatcgccgagccggtcgccatgaccagtgcggcgacgggcttgtaggccaggaacgcggccagccagccgatggtcttggcgaaagcctgcttgcccgattccatccagctcatggcggcccacatgggtgccacgcccacgaggatcggcagcatcccggcgcggaagtaggcgaatatcttgctgatcagcccgcagatccacatcacgatggtgagcacgatggcgacgggcgcgcccaagttgaagaacgagctcgcggccaggcttttcgattcccaggcgtcgttcatcatgccggaggcggatctgagcacgtcggcggtccacgtgtcgaatgtggcctggaacgtgttgaccagtccggcgaggcacacggcgctcaggatcgcccacatgaaggccttgcccaatgggataaggtcgcggccctcctgttgggtgacgagcttccagccggcggcgatcacgccgcacacggccgcgatgataaggaacgggtcaacctgcatacggatgtagtccgacaggaagaacgtggtgccgccgcccggcgtccatgacggcaggtccggattgccgccggacgagcgggagaagaacgtgagcgcgatgctcgcgcacgaggagccgagcagcacgccgagcagtatccagccgatgcggtcgagcagacggccctcgccgccctggccgatgttccacacgatgcgcgcgctcagcacgatcaggctgatcgcggcggctgcgacgagcacgccctgcgcgatgcgcaggtaccggttcaccggtgcgaaccatgaatcgtagtccggcgtggcgttcgcctgcaacgttgataccgtgtcgttcgcggcgaccagcgtgttgcggctggtggacagccattcgatcgtggaatccgattggacctggtacatgttccacagggtcttctccagccaggagagcttgcgctgcttctggcacgaggagtccttgtactcccatttgccctcgtcgggcgactcctcctggtacgtgttctccaacgcatcgcattgcaggttcggcgcggcccggaactggacgcgcgcatacttcttgagctccttgtcggtcggattcgcggacaccattccggcacgcacccagccggcccggtacttgtcgatgacccattggatctggctggggccgatcaggtcgccgagcttgccttcgggtatcttcatcacgtaggtggtctgggtgtcgctgatctgcttgtcgccgaacgtgagctccttgctgaacgatccgaagtcgggtccgccgcaggcggcgaggccggcaaggcaggcgagggcgagcagcagcgcgcacaggcgctgccgtatgcgtcgaatccctttcatggctttttctcagcagcttgcggtgacggacaggccgagtgcggcgaggatggcgacagcgcccgcaccgaggaagatgccgatcacccagttgacgagcttgtcgaaggtgtcgtcgcggtctggcacgccgtcgccctgctggcgcaggatgtgcacgccgatgcgcaccagcgcgaccacgccgatcaccaggctcagcgccttcacccagcccagggcggtggataccgggcccgagaatcccggaggcaggcacggggtcgggtcggaaagggtctcggcgaggatcgcgtatgtttcatgcagcattgggttgttcctttcgtgttaggttcatgcaccatcgtcagccgacatgggccgtggcgcggggcatggcgtctacgtccttcacgagccgtgagtacgcggccggataacgccggggaaacccgtcgagttcaagccctttgatatggggcagccgccacacgcggacggcggatgacagttggatgcgcgccgccaccaaaggccggggcatacggggcacggggtcggtgatggccgcgcccaacaggatcgatgcgccgaacagtccggccgactggtcggcgagcagcgcgcgcaacgattcgaggccgcgccccgtgcccatggcgcacaggatgatgcgcgagggcatggagggatcctggctcaccggcagcgcgcggccggcgtcggcgaaccggtcggggtccgaatggcggatcgtggtgcatccggcaccgccgtgcgcgcccaccagccacacgcggtcggtgacgggtgccgcgaacgacgggatcaacgtggtcagttgtggcatggtgctggtcctttcataggctcgggtcggtgccgggcagttgcgaggggtccgggttcgcgggcaccgaccagcccggagacgcggaaccaccggtcgagccggcggaaccgccggaggaatggtatccgccgccggacgggccggaacccgggcccgaagcggagccggagggcgtgtacgagtactgttgcggtgccggcgtgctctgcgcctgcgccgccgcagccgctgcggcctcctcctgcgctttcctttcctcgtcggccttggtcttcgcgtcgatggaggcgttcaccttgtccatggcgtcggcgatggccttctcgtcgcgcttgtcgatggaggcgcgcagcagggcgcgcgaatattcgtcggccaccttgccttcggaggaggaatacaatcgttcgccctgttcgaccgtatgggccagccgtgaggagaacaccgcgcccgccgccttcttcagccgcgagagatttcccgtgtgcttcttttcgatggcttgcagcttggatgtggtggcgatggccgtttccgtgtccgtggcggcacatgcggggattcgctcgccctcggaatattgttcggccagcttgtcgagggtttccagggtttccgggtcggcgagcttgtcggccgtgaccgctttcgcctgtgcgagccggtcgccgtcgagatattcgaccagcttctgttcggctttcttcgccgcagcgtgggcggtggcgcagtccgccgtcgcctgttccagctcgcgtgcggccgtggcggattcatgcgatctccacgcggacatgccggcgaccgtgacgcaggccgcgagcaggatgccgcccgcggtcgtggctatgcgcctccattcgcgcacgggcatggcggcatcccggtcgccgaccggcgtgaggtcgatcgtgtcggcgagatcggccggctccacggcaccgacaacgtgctgcggttccgatgccggggcatcggccgggatatcattccccaccggattcgaggccgatggcagcgggccgatctcccacggatcgacggccgtgttcgcccggtcttcgcttccggcgtcgtccacgcatcgcgcatccggctccagcccgggcccgggctcgggttcgggttcggccggtggccggcgttccggttccggttctcgtgccgtgccgatggcgacggcggtgccggcggcgattatggggcccatctcccatgggtccgtgctggaggtgttcatcggttcgggaagaggcgctggcgaaggctcgggcggtccggcgcggtggcggtcatgccgtcggcggcgtcggcctgccgttcgcgcagctgccgctgttccatgacccatgcgggatgctggccgtgttcgtgcgcgtccatgaggcagcgcgtgacctcgccctcgggtgaaaccgccgcgagccggcccagatggccggtgaacgcggcctcgggatcgccctgcatgaagctcatgtacgcggccgcctcaagcatgccctcccttcgcgcggaatccgggatgctgttggacagccgccacagcagtgcgggtatgtcctggtggaactcgctgttggcgatctcgcgcacgttgtagtcggcctggtaccacggtttgacctggcccgaggcgaacaggggcaaggcgcgcggatcatgctcggcgaccatgaggaaacgggcgcgttccatgcccggcgatatcagcttggcgcacacggcgtcgcgcagccccgtgtcgccggacagcgacgccagcagtcccgccgtggcatggtccttttccgcgtccgcgccgatgcggtattgtccggcgcgcagcgagtcgagaaaatcgaatacggccaatgcggtttgcctgtcagccatgtgcaacctccagaagaatgatgatggtgcgaacaatgtcagagtcgatgatgcgccgggtcgcgggccgctgcggggcgcaccgtctacaggccccatcgggagcacggttccacgggtctgcggctccacgggttcacgggttcacgggcatgggaaaggccctccgccgggagaggctggcgaagggcctttcccatgcccggaacccgtcgtcgtaacgtctccttcgatcctcacgtatacgaaagaaccgcacctccgatcatcgaatctgaatttcttcagtccaacaatcggggtgcggttcagccatgggacacggccagccaccaagaccccgaaccgttccccggcttaacaacaaaaccggcttaatccgagttaaaccgatgtcggtttaactccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcaccccctccgtgcgatcatggacgatgcgctccgcctgcgccatcgcatgattccgtacctccacaccatgaactggcgcgcatcccggacaggccttcccctggtggagcccatgtattggggatcgcccgacatcgacgccgcataccacgttcccaacgaatacatgttcggcaccgaactgctggccgcgcccatcacggaaccgatggataaatcctcccgacggggcaaggccgacgtatggctgccgcagggcgactggttcgacttcttcaccgggcgccggtatagcgcgtcttcgcccaacggacggcgcatgaccgtctggcgtccgctcgacggaattcccgtgttcgcgaaggccggcggcatcgtgccgatgcagcccctgtccgagggggattccatcaactccgtcgacaacccgcagcatctggagatcatcgtcttccccggagcggacggcgacttcacgctgatggaggattcgggacattactctcggcagatcaccccggcgaccaccgcgatcacctatcgatggcgcaaggacggcgccacatccgcactcacggtatcgccagcccagggagacgttcacgctctgccggcccggagaacatgggatttcctgttccgaggcattaccgacagcgacatatccgtacaggccgacggcgcatccgtcgattcggatcgccggtatgatgccgaaaccctcacattgcaggtaacggtcgccgacgtatccacccgcagcgagatacgtgtcaccatcggcgacacgacgatggccgccgatccccgcatggaagacgtcttcgacatccttcggcatgccgaaatgcgatatctgaccaaggaacaggcttatgccgccatagcggagaacggcatcgacgcattggccacgatggattcactcgagcacgtcagcgggccggacatggaagattgctccgattcgcatatgccgagcgccgtccgtcaagcgctgacggaggtgctgctccgatcctagcccgcatgtcgcctctcccggaatacgccacgggagaggcgacagcagcccgtcacagacccatgtccaggcgaacgccgggccgtcaacacgtcgaggcacgacgcaccagatcgtaggaggtcacatacgtgcggaacggatccgccgacccctcgatgcgcgcgatcagcatatccacggcatgtcgcgcgtaatcatccacatgcgggtcgatcgtcgtcaatccgggcatgcagtactcggcatccggcacgttgtcgaacccaatgacctgcatatcctgcggcacgcgcacgccgcgccgctgcagctcatgaatcaccccgatggcgagcgcgtcgttcaggcacatgaccgcatccggacgcggcgcatccggatcgtccaacagccccgccaccgcatcgcggccgccggactgcacccaatccgcgttacggaccagccgccaatcgacctgcaggccacgctcctcatgggccaacacatagccgcgggtacgcatcgtgctggtggtttcgggccgcgactcgcggtcggcatccgggcatgcgttctccgcggtgccgccgatcaacgcgatcctacggcatcccgaatccagcagcgcccccaccgcggtgcgtacggcctccacgttcggcatcgtgacccaatcggccagtccctgcgtatcgtaatcgcccacaatcaccaacggatacggctggtgcagtatcgtgcgatccgtgatcggcgagcccatgaagaaaatccagccgtccgcggccagcttcttcgtctccgggatcgcctgcgccaagccgccggcgctgttgtaggtatcggtgatcaccgcgtacccgcgggaacgtgccgccgccacgatgctgtcggcgagatagggcatgaacggctggcagaaatcggtgatggccagtccgatgagcttcgtgccgccggttttcatggcgcgggcggacacgttaacgcggtatccgaggcgttcgatggcatcctggacacgctggcgcgtctccgggcgcatactgccggtgttgttcagcacattcgacaccgttttgatggagacgcccgtctcgcgcgccacgtcggtgatggtcacccgtttcgccacagcacccctctcgtcgcaccatcgggcatgttccgcacggttcaggcggaacgcccgtctgattccagcataacgcgttttccccggccggtccggtcccttccgcccggcccgggaagcaagggccgtgcgatccgtccttctccggaacggaccgcgcggcccatcgcgtcacttgatgtgcagggcggtccaactcaccggcggcagggagacgcggaccacgccggactcggcatcgtacatggccgacccgttggcgtgcggggtcacacggttctggtcgtagagcgtattcgcggcgaacagatcgtcgtcgtgcagcgtctgcgcctcgacggatgccggctgcgcgccgtcctgcagcctgatctcgaactcggcggtcgcctcgagcgaacggttcaccgcaaacacggcgagcgagccgtcggcgcagcgcacggccacggcgttcacgccgtcgacctcgccatagcgcggcgtatccacggtgccggcggacagcttcggctccagcacggtgccgcccttggccaggcgcgcggtcacggagaacgggtggaacgtggtctggcgccaggccgggccgcccggctccgtcatgatcggggcgatgacattgaccagctgcgccaggctggcggcgcgcacgcggtcggcgttcttgagcagcgtgatcatcagatcgccgaacaccacggcgtcggcggcggtgtagatgtcctccagcagacgcggggccaccggccagttgccgatgccctcgggggtcttgctcggctcctcaccctggtaccagacattccattcatcgaacgagatgtacacgtcgtgcgcgctcttcagatgggccttggtggcgtcgatggtggcggccacgtccttgatgaagccgtccatatccacgccggaggccaggaagctggccatgtcgcgcgtgccgtcctccttgaagaacggctggtagtaggcgtggcaggagacgaagttcacgttctcgtaggtcttctcaagaacggtctgctcccacttgccgaaggtcggcatgccatgggcggaggagccgcacaccaccagttccacgtccggatcgatctggcgcatgccggcggccacggaggcggcgagcatgccgtagtcctcggcggacttgtggccgagctgccacgggccgtccatctcgttgcccaggcaccacatgcggatatcgaacggcttgtcggcgccgttggcgcggcgacgttccgacagctcggtgccgccgggcacgttcgcgtactccagcaggtccagggcctcctgcaggccgcgcgtgcccaggttgacggcctccatcagctcgttgccgccggtggcctcaagccattcggccatctcgtgcaggccgaattcgttggtttcggtggaatgccaggccagatcgagtcgacggggacgttcctgcttggggccgatgccgtcctcccagcggtagccggacacgaagttgccgcccgggtagcggatggtggtggcgccgagttccttgaccaggtcgatgacgtccttgcggaagccgtgctcgtcggcggtcgggtggtcgggctcgtagatgccggtgtacacgcaacggccaaggtgctcgacgaacgaaccgaacagacgattgttgaccggagcgacctcaaaatcgtcatcgacgacgagacgtgcggtcagatggtcctgctggggcatgggattcctttctacatatctgcatgcactctgcatacgtgacacgtatccatacaacgatgtaccgcggaggcgcgggcgaccggggacatccgtgtgacagccaccagtgtagtacaaccttgtactgactgccggaaggcgtggcgcagagacggctgagaccttttggcgcaccactgcagcaaaaaagatcccaagaagtcgaattacagtcccatccgacgcatagccaccgtgaacatacggcaaaaggcatcaaccacgtcacccgtccacccgctacattcacaagcagtaccgcccactctgcatcattcgcatatgcaaaggccgcgaaccgtacgatgacggttcgcggccccctgacatgccattaggccacccggctcgcaccggctgttcagcctgccggctcagccctcgcgcttgggcgcctggctggccacgcgggtcaggcgcggcgggcggcgcgtggacacgaacagcggctgcacctcgaccagcgggttgtacggcgccaggccgaaccacttgaccggagaaccggccacgcggcggatcgcgtacttgatctgcagcgagagggcgccacggccggagaccttcgactcgggcatcagcgccttgtggatcaccacgtagcggatggtgccgatgccgggatcggcgtcaagcttcgggtagatcgactgctggttcggcagctcgccggtcttctccagatcgtgcatgatctgatgcaggtaggccgggatggactgcgagaccttgaagccgaggcggatgcgcacacggaacaggtagtcggtaccgaagctctcgaccgaatactcacgggtgaacggctcgtcggtggtctcgacggccaccgcccaccatgcgcgggcgcgcttggggtggtcggcgaagatcgagaagaagatgtccgtatcgagacgcttcaggtccggatcgctggtcaggtagacgatgttgtccgcgaaccggtggatgcggctatcgccgcgcagcttgtccagcgcggggaggaagtccttcggcatcatgtgccgacgctgcgagcgctccagcttggtgccctcgttccacgtgtacatgatcatgaggatcgccagcgtgagcagcagcgtgaaccagccgccgtgcaggaacttggccatcgaggcggcgaagaacaggacctggatcgccaggaacacgatggtgaacacaacggcgccgaacttgttgctgcggtgccacaggtagatgcccagcaggatcgtggtggtgatcatcgtgatggtcagtgccaagccgtaggccgccgagatatgttccgaatcgcggaacagcagcagcacggccagcgtggccacgcacagcaccacgttgacgaccggaatgtacagctggccgcgggtacgggcagggtaacagacctgcagatgcggcatccagttgaggccggtggcctcggagaccatggtgaacgcgcccgtaatcagcgcctgggaggcgatgatgccggcggtgaccgacagcacgacggccacatagcgcacgttcggatccatcatctggaagaacgggttgatcccctcggcgtcggccagttcggggttgttctggttgcgcagcatccacgcgccctggccgaagtagttgagcaccagcgccaccttgatgaacggccaggtgaagtagatgttgccgcggcccacgtggcccatatccgagtacagcgcctcggcgccggtggtcgaaaggaacacggtgcccatcagcgccagaccggtggcgttattcggactgaacaggaacttgatgccgtagtacgggttgagtgcggcgagcacggaccagtcgttgccgatggctaccacgccgacgatcgccaggaacgcgaaccagaccatcaccaccgagccgaagaccttgccgatcgattcggtgccgcgcgactgcacggcgaacaggatcacgatgatcaccgcggtgatcatcatcgtcagatccttgttctcggtgaacagatgctccaacgccggcagcgtcttcaggccttcgacggcggacgagatcgacacggccggcgtcagcaccgagtccgccaggaaggccgcgccgccgagcatggccggtatgacgagccatgcgccgtatttgcgaatcaacgagtacagagcaaagatgattctgcagaaacggacatccaaacatcccaattcacatcacacatgaccgattctccagaatcggacacacagaacacatttttcggaactcagacgtccgattcggcagaatcggacacatgtgcacaagtcggatgatgagcacgactatcgacgggcgttcgccggttgtggacgccgctgaaatcgatgcgatccacaccgggcacacgcatgaagacgcacagtatcaacgcgtggtatcgcctggcaccagtgtcatgggaataagcacgttcggctcgaacggcttggggatgttcttgcgtgaagcgttagccgcggccacttcctcattggcaatcgcctgcacgatatggtcggccgccgactgtgcgatcgccgagaaatcctgcgcgaccgcggtcagcttcatgccggccaaatcagtcaaatacgtaccatcgtaggcaacgatctgcagctcgtcaggaatggaaattccacggcccaacgcttcgcgcacgcagaacgatgcaccaatatcggaactgaccacggcatcgacgccgtcggtcgtcaccttgtcgagcgcattgctgaccgcacgatgatagccggcaaaatccatcacttcgccagcttcaacatactcgtatttcacgcctgcggaggtcaattcctgttccaacgtgaggtagtagcgcaccgtcgggaacgtggtctttcccaaatcgaacggtccttcctcgacttctccgcgcgcagccaaatcgaagaattgatctcgcggaccgccaatcatcaccacatgtttggcaccattgcggatcagcatctgcgcaatcaatcgcccaccctgctcgtggtcggatccgattgacgaaataccgtctccaagcacacggtcgaacgcgacgatcgggcgatgaatcgacgtccaataatcgccgggatgcgaagtgtgcgcacacatgacgatgccgtccatcatgtgccgacgcaacatgtcgacatactggatttcgccatccgcctcatctgcggtagagcacagcatagtgcgtaatccttgcgcggcgagtgcatgctgcagatgtgcggtaaacgtcgcaaagaacgggtggcggatggtaggcacgatgacgccgaccagattcgtgcaatcatgatacagattgcgggcaagctcgttcggcacataattgagggcttgcatggctttgcgcacacgttcgcgcatgtcatcagacacgtacccgttgccgttcaccaccagcgagacggtgctcagagacaccccggccttcttcgccacatcgcgcatgccgaccatgatcgcaccttccccgttatcactgttctatcgttgtatgctcacgtgcttaccacgaaatattacattcatttacattctctcgaacctgttcgacagtccggcaacgaaatacagcttcttagtgtcgactcctgcggaggcgaaggccttcagcagcggcttggtctggtcgaatgcaatcaccagcgttgcatccggactggcggccttgatggcggtggcgctcagatttctttcacgttactcagcgaccgtccgtgtaacgtgaaaattacgccggattggcaagcagcgcaatgccgaaaccggcggccacgcaaatgagaggcaccgcgacggttgctattccatagcccagagccagcgtaaaacgacgctggcgaatcaatgaaaccacttcgttgagcgccgtggagaatgttgagaaaccaccgagaaatccgacaacgaacatcatgaccgtgtccatatccaccgattgcgaatagtaggacatcatggcgatgcccgcgcatagcgaggcgacgccgttgatgacgagcgtggatagcgggaagttgcggttcgttcttcgattctcgcggttccagcctcgttgaattgacacgtcgagcacgtaacgggccatggctcccagaccgccgaacagacagatcatccacatcatcagcgcacctccccggtagtcgggtcggcgacaagcgaaatctccgcagtgatcggtttgggctcgaagctgggtggaagcgggttggccggctgctggattggctgcgactgctgctggggctgctggattggttgcgactgctgaatcggctcgggcagctgccccaagtctgaagtatccggctcgcgcaacaacggctgcgatgactgtgtcagctgaggaacgaccagcggaggaatctgcggaacgcggcctgtctgcataggctggctggcggtcggcggcacggttggtgtttcgactcgcggaacctgtcccgtctgcgcggcctgctgcgccgcctgcgcggcttccattgcggcctgcgcggcagaacgcgccacgtcggccactttcacatggcgtacgccctgcgtgtccgattcggcagaatcggacacggaaacagctgaaaacgcaccccgaacccgctttcgagtactccgtgacagcagtgcctgcatcagaaccacgccggcggcggcagtgagcaaaccgcctgcaaaatttcccgcaagatagccaagcgcactggcgatatgccgctcgtgcagaccttccatcgtttccagcatcacgccggacatcgtcgaaagcccgccgagcaagccgagcccaacgccacggctgacaacctgccgcacccggcgacgcagccacgaagcggtcgccatgaattcggtcagcatcgcgaacaggaagcaggcgaccatattcgacacaaacgtgcccacaacgaatggcgtcccgctgaccgacggcaggagcatatccaacgcatgccgacagccgactccaacaaatccaccgacgaacaccacaacatacatcagtccgtcggcgagcggattgaaccgcgcctgcatacgtttcatcggcgccaggggaatcgtaggcggatccatggtgttagcggcgggcgcggttgcaccagcatgcatcacctcaacagtgtcgattgcctgcgtgatgggatgtgagtcctcacccgcagtcaccacgtctcccggcgattgttcttgcgattccattgcgctccccctgtactggccttccgcggacagcgttgttccgcccataggccgtgcaacaacgagctgggccgcggttgccgccttcctaacgcatatgagtttacacggagcgccaacgtatgcaccctggatgtccgattccgcagattcgtacatccagagtccagccgaattcagccaggctcagtcaagccgggcatcacacagccgccgcatcgcaggtcgcacctcgcgctcctcctcgccactgaacagcaccaccagatagtcgccggcacgcagccgtgtatcgccgcgcggcacgatctcgctttcgccgcgacgcaggccgatgatcaggcacccagacggccaacgcacgtcacacacccgcttgccgtccgcaatcgctcccatttccaatggcagttccataatgccgctgcccacatggcttgcgatcgccatctgcatgccttgcgcgcgcacgtaccgctccagcaactccccataaatcggtttggtgcgcagcaaatcggacaccaacagcgcgacgaaagcgacggccgcgaccggcagcatgtgcgtcaacgttccagacatctccacagccaacagaatcgacgtgatcggcgttttcacggacgcggcgagcgtgcccgtcatcacgcacaccgcaaacaccgccactgcgtcggatggcagatcaccgaatcgatgcaacacttcaccgcagatgccgccggccaacgaaccgaccgcaagaatcggcatgaaaataccgccaggcgcgcctgagccgaaactcgtggatgtgaacagcatcttcgccacgaacagcagacacagcattcccaagccgacgcgcgcatgttcggcggtatcaatcagattcgagccgccgccgagcacatcgggcaaccagatgccgacaggcaacgcgatcgcaatcgcaatcatcgggcggctccatgccggcagtttgccgtacagcgtctggaagccaagcaacgagcggttcatcagcgaaccaaccaaaccggccaccaatcccaacggaatcagccacacatactcttccaacgacagctgaccgatatcaccgaaatccaaaaccggacgcagaccgaaacagtattttgagacgaaatcggcggtcagcgatgcggcggtggcgcccatcagaatcgcaggggaaaaactccgatgcaccccttccaaagcgaacatcatgccggacagcggcgcgctgaacgcggcggacaagccggccgcggcaccggcggtgaccagataatgctcctgcatgtcctcacggcggcggccgcgcaaacggtgggatacacactgcgcgcccgacgcaccaatctgaatggacggcccctcacggccgagcgacagaccaaacaacgcgcccaacagtccaccgacgaaacggactggcagaatcgtctgccaacgcatcttcaagccgcatatcaccacgccgttggtctgcgggatgccgctgccaccagccatcggctccttgccgaccatccacgcgattgccagcgcggccgccaccgcggcaaccgcccacggcgcaatcagccacggggtctcgcgaatccgcgcatatatccaacgggacgcatccgtgccgtattcgatgccgagacggtatacgacaaccagcaatcctgaaaccagaccaatgactatgccggccgccgccatcttccacttcaagtggtcgaatcgcggaatcagccggcggatatcatgtgccgcgtcgttaccagtcaagccgggaaattcgttgcagacggtcagtcgaccagcgaattgatctggatgacatgatcgcgctgcggaccggtgccgatcgcggagatacggcagccgctcagctcttccaaacgcttgacgtaggcctggcaggtggcgggcagctcgtcgaaggagtggcagtcggagatgtcttcgtcccagccgggcatggtctcgtaaatcggcttggcggcggcgaaagcggcctgatcggtcggcatatcgtcgtgacgttcgccgtccacgtcgtaggccacgcagatcggaatctccttcaggccggtgagcacgtcgagcttggtgagcacgatgtcggtcaggccgttgacctgggaggcgtaacggttgacgaccgcatcgaaccaaccacagcgacgcgggcggccggtggtcacgccgaactcgtggccctgctgacgcagccattcgccggactcgtccagcagttcggtggggaatgggccttcgcccacgcgggtgacgtaggccttggagacgccgattacgcgggtgatcttggtggggcccacgccggtgccggtgcaggcgccgccggcggtcgggttggaagaggtgacgaacgggtaggtgccgtggtccacgtcaagcatggtggcctgagcgccttcaaacagtacggtcttgccttcgtcaagcgccttgttgagaatcaggccggtgttggccccgtacggcttgaggcgttcgccgagcttcagcagctcctcggtggtctggtccacgtcgatcggacgacggttgtagagcttgaccagcatctggttcttctggtgcaggctggcctccaccttgtcgtgcagatggtcggcgttgaacaggtcatgcacgcggatgccgacacggttgatcttgtccgcgtaggctgggccgatgccacggccggtggtgccgatcttgtgcttgccaaggaagcgttcagtcaccttgtcgagtgtgcggtggtagggcgcgatgatgtgtgcggcctcgctcaccttgaggtgggagcaatcgatgccgcgggattccaggccgtcaatctcctcgaagagcacttccgggtccacgaccacgccgttgccgatcaccggggtcaggttcgggttgataataccggagggcagcaggtgcagggcgtacgactcatcgccgaccaccacgctatggcccgcgttgttgccgccgttgaagcgcgcgacgtaatcgaccttggtgccgatcagatcggtagccttgcctttaccctcgtcgccccactgagcaccaataagaacaattccaggcatgatgcacctccgcattcgcacgattccgccggaaacagactaccgtacgccctctaccctgcgaagtttcgtctcacgcagggcgaggctggggggtgcgacgacccggaatgggtgacgaatttctactcgtacgaggcggcgctgtgaccaatcgcacaagcgcacaggttgaagaacggggcctagcgggcatgcctcgcgcgataatgaagccatgacgatcgcaacaccggaacgctatgccgaaatgctcgatgccgcccgccgaggcggttacgcctatccagccatcaacgtaaccagctcacagacgctgaatgccgcgttgaagggcttcgcagacgccgagtccgacggcatcatccagatttccgtgggaggcgcggcctacgtctccggcaggggggtcaatgatcgcgttaccggctcgctggcgctggcggctttcgcacatgaagtggctgcgaaatacccgaacatcactatcgctctgcacaccgatcactgcgccaagcagtatctggatgagtgggtgcgtcctctgctcgcgcatgaggccgatcaggtggcacgaggccaggagcctacattccagtcgcatatgtgggatggctccaccgtgccgctcaaggaaaatctggacatcgccgaggaactgctcgacaagtcgcagaaggcgcacaccgtgctcgaaatcgaaatcggcgcggtcggcggtgaggaagacggtcactccgccgaaatcaatgaaaagctgtattccactccggaagatggcctcgaagtcgcccgccgactgggtttgggcgaacgtggccggtacatggccgctttcacattcggcaatgtgcatggtgcctacaagcccggcgtggtcaagctgcgtccgtcgctactcggcgacattcaggcgcgtgtggcgcgcgcggtggccgaaggcgagttgcctagcgcggccggcatagtcgatttccccaacggcaagccgtttgagctggtgttccacggcggctccggttcacgcccggaagaaatcgccgaagctgtaagctacggcgtgatcaagatgaacatcgacaccgatacccagtacgccttcacccgtccaatcgccgaccacgtgttcgagaactacgacaaggtgctgaagatcgacggcgaagtgggcgagaagaagttctacgatccgcgttcttggggccgtaaggctgaggattccatgtccgcccgcgtggtcgaggcttgccggcagctgggttccgcgggcaaagcgctcaaatagcgcgtagttttgcgatcgtgcgcgacactttcccggaaataatgaaaatcattgaaaatcaatggagcggacaacgggagtcgaacccgcctctaaagcttgggaagctttcattctaccgatgaactatgtccgcatgccttacggctgctgcacctcacgtgacgagcatgctcagccaaacgaggcacgaatagttatcctagcacgtcacctgccgacgcgcgtggagtaggtgggcggagcgatcggcgtgccgttcatttcgttggccatctgcatgagacgcgctatgcgctcatcggtcggcgggtgcgtggagaacaagcgcgagaaaccgaccgcggagaacgggttggcgatcatcattgcggagacggactgggtgccggcggttttgcgcatcggcgtggtctgcgcgccgtaggaaatcttgttcagtgcggaagccagggcctcgggatcgccggtaagcaggctgccgtcttcatcggcgtcgtactcgcgggtgcgggagatggccatctggatcaaagacgcggcgatcggcgcgagaatcacgctcagcaatgcgccgatcaggccgaggccaccggaactgtcgcggtcgtctcgcgaaccgccgccgaaatacatcagcgaatagcctaggtaggagatgacggtggccatggcagaggcgatggcggaagtcaggatgtcgtggttgtacacgtgcataagttcgtggcccagcacaccacgcagttcacgggcgttgagaatctgcaggatgccttgggtacagcagacggccgcgtgccgttcgttgcgcccggtggcgaaggcgttcgggctcatggtgggggcgatgtagatgcgaggcatcggcttgccggccttggcgctcagttcacgcacaatctggtagatctccggggcttcctgctcgctgacttcccgcgcgcccatggaggcgatggcgagtttgtcggagaaccagtaggtgccgaacgtggtaatcaggccgatgacgatatagatgctcagggtttgccgactgccgcccggggcccaccaaatcagcatgatgatggcccacatcagggcaaacagcagcgttgttttcaggccgttgaaatggccgtgcacccgtactttggcatccataatgcacacactaaaatcgcaggctgaatgattgctggatatgcgccacgcgcaatgtcccatattcgcccggcccgtccggccccgagcccggccgcgtccgcacggggcgcggccgggtggacgaataccggacgggcgtgggcgaacgtcaggccagggcgagctcacgcatctggtcgggctcgatgaccttcttgtgctcgcgaccttccttggcgccctcggcgcgctcgaaggcgtcgaccttcttccagccggcgaagtcgatcgggcgaatgccgcgctcggccagcagtcgatcgatggattcgggggcgcggtcggctgccacgcggccaccttcagcggccttggccagatcctcgagcatgttggtcacgatggcgagcgcatcggacttggtggagccaatcagacccaccggtccgcgcttggcccaaccggtggcgtacaggcggtcgcgcacttcgccgccgtcggcctcggtggtgatgcggccgtcgccgttggcgttggccaggtgagcgccgtgctcgtcgtaggtgatgccgggggcttcggcgggcttgtagccgatggcgtggtagacggcctcgaccgggtagtcggtgaactcaccggtgcggtgcatcttgccgtcggcaccggtttcggtgcgctccacgcgaatggccttgaccttgccgtcctcgccgaggatctcggtgggggcggagttgaagtgcacgtagtacttgcggtcggccgggttgccttcgaagtcgacgtcgccgtcatcctccatgtcttcggccatctcgcggatggcgaacagctcttcgaccatctgacgagtgagcttgtccttgccggccacctcgatggtctcgtcgtccagatcgaagtcgtcttcgttgatgatgagctgcacgccgggcagcttctccatctcgcgcagttcctgcacgctgaacttggcctgggccacgccacggcggatgaacaggtggagcaccttggccttgttctggccgatgccctcgtacacgttgtccggaatatcggtcttggccttgaggtcgtcggcgttgcgcatgagttcgcgggccacgtccatggccacgttgccgccgccgattacggcgacgttctcggccgtgagcggccattctcgggcaccggtggggtaaccgtcgtaccattcgacgaacttggcggcaccgtacacaccttcaaggtcggcaccgggcaggttcagcggcttgtccttgaccgcgccggtggcgaacagcacggcgtcgtaacgggccagcaggtcgtcaagggtcacgtccttgccgaattccacatcgcagtagaggtggatgttcgggttgtcgagcgtcttctcaagcgcggaggcgatgaacttgatggacgggtggtccggggccacaccgtaacgcaccaggccgaacggcacgggcagcttctcgaacaggtcgatgcgcgcttcggtgccgaggccaagttcttcgcccagcttcttgagctggcgcaggaagatatcggatgagtagacgccggccgggccagcgccgataacagcaatgcggagttcagtattcacggattcagtcacgcgctctagcctaacgcaaagccttccgttgcgacagagggagggtggtgggaattctgtgtattaggccatagtttgtgcgtttgggaaacctacgagcactgctaatgtcagattatgggttttcctattggtcaagttattgccgttctcattccaagaagcatgcaaggcggatcaggcccttactccggatacgtttatgctgcaaggcggttatccacgcatttacgacacgagaatgccgctcaatctgttcttctcgaactacatcgacacttatatcgaacgtgatgtttccgaatatcttgatgtacgcaatttggctgacttccgccgattcttgactctttgcgcactcagttccggagcactcataaactacaccaacatcgccaatgaacttggtgtaagtccgcgaaccgtaaaggcatggatgtcgattctggaatcaagttacatcgcattccatctcataccgttctacacgaacgcacgcaaacaggtggtcaaaacgccgaaactctatttttatgacactggcttgctgtgccatctcttgggcattcggacggtcgaagcactggttgcgcaccccaagttcggcgatatatttgaaaacctcatcattgcggaaaccatgaaacagcatttgaacgccaatcaggagccacaattattcttctaccgcgatgccagcaaggtcgaggtggatttgttggatttcaccgatcctaacaaccgtatgctcatagaaatcaaatccggacaaacctatcatgaccgattcgctcggcacctcactttaattggcaatgttctcggtataccgtgtgagcaacagtacgtaaccagtcgggttgaacatagttatgtctcacaaggaatccgcgtcacctccacccctcgattggctagaaggccgacggtaaagagccgccgcagagcagtaggaattctgtgcaatcagtgaatcccttgaggcattaaagacgtcacctccaacggctctttacgacctcgattgcattcattaggtcatttcttcgtccattaggtcggagggtgctgaagccatcccttggaacggcggggtttcaagggccgctccgaccaaggaccgacctaataaacgtcaaatcgacctaatgaataactccgatgctattgctgctttcgtgggtgggatttccgtttccgccacgtcaccaaccgtatcgccccgattatgtttcgatgcggtggactcgacatacgaccatcccggtcagtcaactgacctacaaaaacagcagaagcctcatattcttaatcagtcccgatcaattagggcagtgagggcccagaggatgctcaccacgtcgatggcctcctggaggaaggcaccgacgacgaccgggataaggttgaacgcggcggcaatcatgccgatggtggcaagcacaaggcccgcgattacggcttgaagcatcacgcgcttggtgcggcgtgcaatggcgatggcgcgcggcacggcggcgatattgtcattcataatgaccacctgagcgctttcggaagcggcggtggacgtgccatcggtcatggccacgccgatatcggcaacagcgagcaccggggcatcattcacaccgtcaccaaccatcatcgtgacggttttgccggctcctgtagcggccctgactgcggctaccttatcctccgggaacagttcggcgtgaacctcgtcaatgccgacttcgctggcaatgatattggcggaagcccgcttgtcaccggtaagcatggcgagctcggtgacgcccaactcatgcagtttggcgagcactgccttggcgttggcacgcggcacatcgcgcagcacgatgcgcgcgatcagccggccgtcaacggacacgtaggacgccatctcatccggctgcagcaggccaaagcgagtgcgcaggtcatctttttgctgagctccccctcttagggggagctggccgcttcgcgggctgaggggggcagcctcgccgaccgccaggaatccatcctccccagcagccgcgaaagacagccggccaacgcgcaccgcgtgtccgttcacctcgccggaaacgcccttgccggcgtcttcattgatgttcttgacgaccggatactcccggccatggccaggccagctggcctccggctctgggcacaggcgctggccatcctcgaaccgctggcgcagtcgggccagcgcctccgcgccggccttggcaatgcctttggacaggatgtgcaccgagtagctttccaccgcgccggccatcatcagcacatggtcttcgttgagacgggttgcagcgccgggcaacatctcgacgcgcaccacctgcggctgcttgacggtgagcgtaccggttttgtcgaagaacacctgcgtgacgcggccaaggttttccagcacgtcctgtgctttgataagcacgccggctgcggcgaggcgtccggttccggcgatgtatgccaccggtgcggcgatgagcagcgggcagggcgtggccagcaccagcacctgggcgaatcgcgtcggtaccccggacaccgcccatgcgacgccggcaatcaccagcgagagcacggtaaagggcacagccaagcggtcggcggtttttaccacggccgggcgcgactcctgcgcggaggccacgagctcgaggatgcgctggtactgcgaatcggcggccacctgggtggcacgcatggtcaatgcagtcgagccgttcaccgcgccggacatcacgcgggcgccggcgaacacttcacgcggcaccggctcaccgttgatattgctcaggtcgagcgtggccgtgccggacagcagctcgccgtcaaccggcacagtttcgcccggcaacaccatgagtacgtcgcccagctgcacctgctcgaccggcaccgtgtcgaagcggtgcgcggcggcggcagccgatgccaagcccacacgccggaagccatcggacgaatcgcccttatcggcagcaaacccacgccccacgccaggcaggttgacgacgtgcgcggtttgcggcgcggcctccatcagcgcggtcaggctgcgctcggccttggcttgagcgtattcctcaatggcctcgccggacgtgatcatcagcgtcaccgcccaacttgcccagtattcggcgacggccacggtggagaggatcgcgaccacggccagcacatcgactccaacctgcccatgacgcaaatcgtcaatcatgccgcgcacagtgtcaatcacgataatcagcaccagtgcgataaccagccactggccgaagcccggattgccgagtaccggaatcgccatcgcattgccccacggacgccaatcgcctagtaaagccaacggaattgcggcgatgacgacgaccggaagcatcggcacaagcttgcagatgtcgagaattttggtgaagaatctgatgagtctgctcatcattgctccttacgctcgtatacggagtcgattgcggtacggcaagcgtggcccgcgcaatcggcgctacggtcacgccttgttaacccaccggcggctttgcctggggcttcgctttgctcggctcccgcgcaaccttccgatacacggcgtaaagaaatgtattcagttttgtattgaattatgcgctgtgttcaggacgtcgcccgaactcagtgcttggcctaccctatcaacgagcgttgtgcgacatgccggatatcgaaactacgttggcggcatgggcgcagggcacaatagcgcatacgaaaggcctgtggcaggagtttgctcactgccacgggcctttgcttgtctgacacggtgttcagcggttaccgctcaacaccgtgtgacgttgttgggtcggctttaccacaggccgaacgggtcggagaagccgccgccgtcaccggtgccgccatcgctgttgccattgccattgccgtaaccgttctggccattgccgttctggttgttctggttattctggctgttgccgttggaatctgagctggacgaaccgttcaccgacgactcctcctgatcgagcgtcacgtccacatccatggtcttgccgtcgcgcacgatggtcagcgtcaccttgtctcccaaagccgcggcacgaacgtaaccaagcagcgagtagttgttgttcacggcgttgccgttgaaggccacgatggtgtcgccctccttgaggccggccttgtcggccgggccgccggagacgaccgcgctgccggtggcgctggacttggtgatggtcgcgccgccgcgggtcacgccgtcggcttcaaccgtgtcggacttgatgaccacgccgagggcaacgtgcttgaccttgccgtccttgatgatttcgtcggccacacgcttgacgaggttggacgggatggcgaagccgatgccgatggagccggcggagtcggaggaggtggcggtggaggcgatcgaggagttgatgccgatcacctggccggccgcgttgaaggtcgggccgccggagttgccggggttgatggccgcgtcgatctggacggcgttggtgacgatctcgttgttgttgtcgtcggtcacggtcaccgggcggttcagggcggagacgatgccggtggtggcggtgtcgtcgtagccgagcgggttgccgatggccatcacgttctcgccgacggcgagcttgtcggaatcggcgaattccacggccttgaggtcgctcggcgggttgtcgagcttgatgaccgcaagatcggtggtggcgtcagtgccgacgagcgtggcggaatacatgttgccgttggcaagcgtcacctgaatctgctgggcgccggagatcacgtggttgttggtgatgatgtggccttcggtgtcgatgatggcaccggagcccttggcggtgccgttgctcaacgcggtctggatggagaccacggagccggagacatcgctggcgacagtctgccagtcgggggcttcgccgctcttggcggtggcggacccggagccggacttattcgagctgacgttggacagcgaattgctggtcggcaaggtgatcaggccgctggtgagggcaccgtagccgaggcccaggcagagggccgcagccagaacggcggcgaccacggcgatgaggatgttgctcgccgtcttggacatgccctgcttggcggggccgggctgaccgggctgaccgggctgtcccggctgggtcggaccttgaccgttcggcgtaccggtaccgttccgagaggagtcggcggcgcgctttcataagggcacacaatcccaagatcacacccacagatcaataccgatcaatactcgtacgtgatcgcggggtcgccgatggtcggcgtctgatccagtttgaggttggctgagctggccgcggtggtcacgtcgtattcgatggtcaccgtgtcctgaggcgccagggagatgtcgtccatgtaggtcatatggtccttggcctgcacctgcgcgaaggaactgccgttcgacgccgacacattgctgacctcgcctccggccggcgtgtagatgaccacgcggttcaccgccacgcctcccttggcgttcgccgtgatgtattccggcagggatccggcctcgcccggctgcagggtgttggtgaacgaatacgtaacgtggtaggtgttgtcgccggtcctcttcaccgtcgacttgcgctggatgtaccagtccatcttcgaggcctgcatctcgttgaggtagacgccggccaccgggttcttcgcgtcgttggtgatctcgccggtgacgccggcgctgcgcagcaccgcctgatcctcctcgtggaacgaccagaagtacaggtgccgctgctcggtcatccggagcatcgtcttggcgacggtcatgagcttctgcgtgttcatgtcgctgaacaggtgggcgaccacctgggcggcggtctcgctgaagtactggtcctgagcggagggcgccagttccttgtaggcgccgttgagcaggaattcggcggtgttcgacccgttgagcacgcgcccgtcggacagggtcacgtcgccggtggcgccgatcatcgcctgcagcgcgacggggtcgagcgacatcacgccgtcggacgatccgccgaacggagccgcctgccagaacttctgggccatggacgcgacgcgcgggaagtccggcgtggacgaaagattatggacgcattgaccgaagtacagtccgctgtacagcgtgccgtcaccgtcctggttgacgtcatccaacgcggcgttggaggggaactcggcatccgcgtggaactcccccaccgcgatcttgccattgtccgcgctgaaggaaccggccgaaccgatcaggccgccggtgccgcggatctcggaattcgtctgggccagcagcacgtagttgcgggcgccgttcgcaccgaggaagttcggcagcatgttgagcatgccgctcaggttttcggtcacctgcgccagggcggccatctgcgtcttgccgttctgcagcgcgttgttcaccacgccgagtttggcgtcgggaagatcctggatcgtcctggcctgcgattgcacggactggtcgaccgtggcaagctgctgcgccgcggcgatgatcggctccatgttgagctgcccatcgccactggagaggctggcaccggtcagtgtggtgacgaccttgcccagctggggcagcgtggtctgcgcgaagtcatcgatggtaccgatggcggtgcgcgccgtcttcacgtcaccgccgaccacgggcatcttctccgccagcgtccacagaccgccgctgacatcctgcttggcggcggccgcctccttctggatgtggctcacgtcggacagcgccttgaccatgtcgtcggtggaaccgtccttgatgaccttggccgcgttgacaacattgttgaggtgcgctttggcgctcatcgccgacttgtacagtttgaatccgctgaagccggccgccgcggcgcacacgaccagcaacagcagcacgacgagcagcgcgttgcgaacgcgatgggttgtcctggtgaccgtgcgtgcgtgtgatggcatgggctacttccttacgttatgacatatatcgatactggctagctgcccggttacgctttcgctggacgggtagcccggcggacggcacgtagcagtgcacgacgtgcacatcgcgtatgatgccgggggtacctgaccctccttgcggtaggtcaggtgttgcaacgatcactagaacccgcccagccggcaacacccccaggggggggtggggtgacgaccaccccgcttggaccgccggtgagctgtctgccgggtgcgcagggttcaaacatcgctggcgggccgccgcgagggcggtctcgtcgatctgtcgctagggcgcaaggccatgacgagaggtgaacatcatgccaagtggaggcaaacgagtacgctccgggccggccaaggacccgaacagcgagaagagccgcagactcggatacacattgcagagcctgccgaacaccgagtgccggatgaagccgccggaatggcccttggagcccgccgatgacgagcgcgtccgcaggcttgaggcggagaagtggaagtggctgtggaagctgcctcaggcacgcgcctggcatctgccccagttcaagtggatgattcacgaactggcgttgtacgcgcggctttccaccgcatgcgagatcgcgccggcacccacggcgttgaccgtgctgctgcgcatctccgaccgcgtcggcatgagcgccgccggattgcaggcattaggctggaaaatcgaggccgaggccgagcggaagcccgtcgattcggagttcacgcgccgcagggccaaggagctgaaccgggaatcggccgccgaacgctctcccatggacgagacgaggcatgtgtaccagcgtcggatgagcggcaatggctgacgaggattcatggctcatcgacttccccacgttggggcatctggtgtgcgcgtggatcgaacgtcactgccggcagcctgacggcccgttgcgaggccgtccggtggtgctgtccgactggcagtactggctggcggcgaaccgttggcgcatccgcgtggacgccccatatgtgccgcccgaggaagtcaccgtcgacaacccgatggtgctcaatcaggcgttcgaataccgcatgacgctgaccgtcggaccgcagaaatggggcaaggggccatgcacggcgttcttcaccgccgccgagggctgcgggcccaccatcttcgatggctgggcgcgagaaggcgacatgtaccgttgcgccgacaacggctgcccgtgcggctgggagtggccgtacaatccgggcgagccgaaaggccgtcgacatccgtcgccgctcatccagctgaccgccaactccgaggaacaggtacgcaacatctaccgtcctctcgtggcgacgatcctgcttggcccgctcaaggagctcatgcgcgtgagggacaccttcatccgcatactgcagccggggcgcgaaggcgaggccgacgccttggatctggaccgcatcgacgtggtcaccgcctccgcgaaatcccgtctgggcaacccgatcacggacgccgaacaggacgaggccggcctgtacacgaaatcgaacggcatgatagcggtcgccaccacgcagcgccgaggagccgccggcatgggcggccgcacacatgcgtggacgaacgcatgggatccgggcgaggacagttacgcgcagcaggtgttcgagaacgccgaggacgacgtgttcgtgttctaccggaaccccgatctcgcgaaatcattgcgtcaccgcgacggccgcccattggacttcaacctgaaatccgaacgcttgaagatgctcgaatacgtgtaccgcggctcaccatgggtcgacctgaactccatcgaatcggaagccaaggcgctgatgaagaccgaccctacccaagcggaacggttcttcgggaaccgtctggtgcagggcggcggcgcatggctcgaagacggactgtgggagagctgctatgccggcgcatgaactctggttgccgaacccgccaaaaggcacgcgcgtatgcgcgggcttcgacggttcggagaacgacgactggacatgcatcaagatggagaccctcgacgggctgatattcactccccgatacgggcccgaccggcgtgcgaccatctggaacccgaagcagtggggcggccgcatcccccgcgccgaggtatccgcagcatgggcggaactcaacgaacgctacaagatagaacgcgcctactgcgatcccggcttccgcgacgaactgtcatgggaatcggagatagaggcatgggacagggcctacgggccgaagaaattcctaccgtggagcatgtcgggcagctcccgcatcggagccgtctacgaggcattgcgccgattcgaggccgacctgaccacgcaccgcatcacgcaggacggctgccccgtcacccgcacccacatgatgaacgcgcgaaaggtcgccaagaccctggaacgctacgggctggcgaaaccccaacagaacaggaagatagacgccgccgtgaccagcgtgctcgcccacgaagccgcatgcgacgcacgggccgccggctggggcgctcgcaaacacaattacatgcttaccggatcatcgaccagaaggaggtactgatggaatacagccagcaggatctgtccgcattggcgaaccgactggccgataagatccagtttcgcaggcccagcatcggcacgcataccgattacgtgctcggcaaacgcggcaaactaaagttcgcgtccaaggaattcgaacgctacatgagcgaccggttctccgatttctcggacaactggtgcctccccgtggcgcaggccccggtggaacgcatcaagttcaagggcttcgtcccttatgatgacgtgaagctcggcaccggcatcatgaaatgccttgaccgcaacgacttcgaacgtgggttgcaggaagccgcactgatgatgaccaccacgggtcgcgcgttcgctttggtcacgcaggtcgatggcagggcacgcatcacgttcgagcacccggacagcgccgccgtcatctacgatgcgcgcaccggccagccttccgccgggttcctcatccagcagggcgacgacaaggagtacggcactctcatggtgcccggctggacggtcagcatggaacgcaagaagatgctcggtctgaccgaccagcgcgtgccgcccgacgtgtacggctggaagatgaatgaccctcagcccaccggtctggacacgattccactgcgcgagttccgcaaccagatgctattggacaatgcgccgatcagcgacatcgcgcacgtcgaatcgatgcaggacacggtcaacgtcgtatgggcatacctgctcaacgctctcgattatgcgtcgctgcccgctcgtgtgatcctcggcggagacccgctcgtcgagcccgtctacaacgaggagggacagcaggtcggcgaaaagcccatcgaactcgacaagcaggtgctggagcgcatctaccagttcaccggcgacaacgtgaacctgggcgaatggtcaagctcgaacctgaacgtgttcatcccggtcatcgaaaaagcggtggagcatatcgccgccgaaacacgcacccccggccattacctgctgacaaacgcggaggttccggccaccggctacgaggtcgccgaagccggcctcgtatccaagaccatcgaacgcatcagcttcctgaaatcccccatccgcgacatctgcagcatcgccatgcgctacgagaacgacgtggctgaggcggacatcatcgccgactccaaggtgcagttcgcgaccccgcagtatcgcagcgagacgctgatggcggacgcgatgctcaagtacaagcagctcggcttcccgatccaatgggtcgcggagcagatgggccaaagctcggacgaggtgcagcgcatcatgcgcatgcgcgccgacgagatggccgaccccgaactcgaatcgttgaaccgtgccctgcagatcggaggcgctgatggcggtcgaatcgcaggtgctggcctacagccagaaacggctggcgacgttggagctggcggcggacagggccgctcgcagaacatggaacagggtcgacgccaataacatccaggcgtcgtggaagtcgataagccgcgacttcctcaccctgttctccaccatccaaaccaagtcggcggagacggccatcgacgcgagcggcatgatgctcgccgaacagggcgtgtacgtcactccccatgctttggctaacccgaacgcattcgcgggctgggctccgtccggcctcgacatcgcatcctacttccaatcccccgtgttcgccgccttgcacgcgatacgcaccggcagctcgccgttggaggcattggaatatgggcgcaacctgctggtcatgcttacctctctggcggtcatggacaccgcccgccaggcggagtcactggacatcaccagccggcccaaggtcggctacgtgcgtgtcgaatccgccacctgctgcgacaggtgcatgatattggccggcaaatggttccgattcaacgaggggttcctgcgccacccccactgccacggccgccacgtgccctgcagccagagcatggccaaacagcagggatggatcagcgaccctatggagggtttcaaaagcctctcccatgaggagcaggacaaacgcttcggcacgaactacgcccaggccatccgcgacggggccgacatctaccaggtcgtcaactcgaaacgcggcatgcggaaggtgggcaaaggctatacggcgttgaccaccagcgagggcaccacccgatacgggtgggccagcatgcaatacgcgcaacagtccggacggaggatgaaacgccgcctgtccatcgacggcatctactcgctgaccggaggcgaccgggagaagaccatagccgcgttgaaggccaacggatatttcgtggacaacgactggcgcggcaaggtgtccgagatccgcaagggcatgtggctgcacgacaacacgtaccggcaggggcgcgtcgaactgttgaccgccgccgagaagcgcgtgcagaccgcgaagctccgctacgaggccgtattggagggacgcaatccgaacgatggccgcatgcccctcacccccgaaatcgcggcccagtgcgaacgcgaataccgccgatgggtcacctccggcggccagattttccagcaatgatccagcgaatcgaaaggaagaacatggatcccgcaaaccagaaccagcagacaggcgacaacgagtccaagaagccggagaacaccggcggcgaggattggcagtcgaagttcgagggccagcggaaagtcaaccgcgacctcgaaaagaaactgaacgaagcctacgccaaggccgacaaggtcgacgaactcgaaaaacagatcgccgccctgcagggcaaggaggccgaatacgaggccacccggaaggagcaggccgtcaaggacgaggcccttgccgccgccaaccagcgcatcctcaaggccgaagtccgcgccgcagccagcggcaagctcaccgacccggccgacgccctgcgctacctcgacctgtccaaattcaccgtcacggctgacggcggcgtggacacgcaggccatcgccgactccatcggcgaactgctggaacagaaaccttatctcgggaaagccgagcaagcgccctcgggcgcgaacatcacgccgcccagcggaacacgggacggcgaccgccatcagggtcagctcacccgagacgacctgaaaaccatgagccccgcagaaatcgtcaaagcccaacaggacgggcgactgaacgatctgctcggagccaactaaacggaaggaggccttaaatggccatcaccaatttcattcccgaactgtggagcgccaacatcctgctggaactccagaagaacctcgtctacggttccgcagtgaaccgcgactacgagggcgacatcgccaactacggcgacaccgtgcacattaccggcatcgcgcacatcagcatcggcgactacacggcccacaccgacatcaccatcgaaccggccacagacaaggacgccggcgaactcgtcatcaaccagagcaagtacttcgcgttcgaaatcgacgacgtggagaagcgccaggccatgaacaacctgaccgccgcatattcccgggacgccgcctacaagctgcgcgacctgaccgaccagtacctggccggcctgatggcagcagacgcgaagagcaagctcgacccgatttccggcgccaccgccaccaaggcgtacgacaccatcgtggatctggccaccgcattggataagcagagcgtgccagacgcgggccgttgggtcatcgtcaacccggacttctacggtctgctgcgcaaggacagccgtttcgtcgctggcgccgagtccgctcattccacgctgctcaacggcgtggtcggtgaggccgcgggcatgaccatcctcaagtccaacaacgctcccgcagccaagggcggctctgcctcggctcagaccgatgagggcaacgtcatcatcgccggcaccaacgcggccaccacgttcgcggagcagatcgccaaggtcgaggccacccgcaaggagaagggctttgacgacatcgtcaagggcctgcacctgtacggcgcgaaggtcgtgcgccccgaagcgctggccaccgtacacttcaaggtgggcaagtgatggccggcagctatgaggccatgccctacttgggcgaagccgaataaccgcatagggggtgactcatggacacgctggcaacggtcaaggaccttgattcatacggcatcgaatacgcggacgaaaagctcgcgggcaagctgctcgaatcggtttccgcagcggtgcgcgacgccgcagggtgccccatcacacgcggcgaatacacggtgaccatccccggcgaaacctcacgcaggctcgacctgcccatgcgccccgtgatttccgtgagccgcgtgctcatggacggcgaggagaccggggattggaagctgctcggcaacgccctgtacagggaaagcctgtggagcctgccgaacatggtcccccgctccatcaccgtcaccatgctcgccggctatgacccgatccccccggacatcgtgcgcctcgtgtgcagcatggtcgcagccggactcgtccagcagtcgaacggcggccccggcgctcaccgcgacgaatcgtacgcgcgaatcgacgacgtgcagatcggctaccgtcagggcgactccgagatcatcgacgcactcgaactgccggagggcacgaaacgagccctccgcaacaggttcggcatgcgaggcatcgccataggggtgttccgatgaacgtgcagcatatcctcaaccgaggccgacagctcgccgaatcgttgatgaccgaccagtgccgcgtcacccatatgggcaaaccggtcaccgaccccgaaacgggactggtggaaccggctgcgaacaccgtgtatgagggcaagtgcaaggtgcagacctcgggcggtctggctgccgagaacacggagggcggcatcgtcgaagcgttgggtgccgtcactcccgtgtggagcatgtacgtgcatttcccctacggcaccatgggtttattgccgggtgacgtgtgcgagataaccgaggccgccgacccgaatctcaagggcaggaaactccggttgttgaacatgcagtccgagaagacacactccaccgcatgccggtggaatgtgaaggaggtgggcaacagcaatgagtgacgtgacagtcgacgcttcggagctgaccgctttcggccgcagggtcgccgcagcgcacgccatggcttcggtcaaggtcgcgcaggcggtgaagaagggcgcgcaaaacgtcaaggaaggcgtcatctccgacctgcagacatcatcgaactacgcgatcagccgtatcggcatcggctacgaaatgggcagcaccggcaccaccatttatgcggatgtgagcccccgcgacggcggggcttccgacttggccaacatcgcgttcttcggcaccgcgaaaggcggcggaacccactggttttaccagttcgccgaacaggaattgcccacgctcgccgaatacgtgggagacgcggccgacgacatgctgataggagccatcggattatgagcgtcatggacttgaccaatgcggttctcgatctgctgccctccatgccgtccggcgtgaaggtgtacaggcaggaggagccattggagtcggagatgccgccgtggatcatcgcgcacgtctccaccgaccgtcatgtgatggcggagacgatgcggttcaccgcccactccgccctgttggaggttcgcgccgtcagcaccaccgccgacagcgtgaacatctggtgtgacgacatgctgattcccgcgttggcgaaccgctcccccacccggccgccgggctacacggtcggccagctcaccctgtacgaggattccggcgcatacccggccggtctgaccgccgacgacaccgcgcgccgctaccaggtgcgcgtcctgaggttccgcttcacgtggagccgaccgtaatcaaccaatcatttaccaaaagccttcaacgccaccccatacggggggtggctttttgctttaaggagcgcatcatgaccctgaaactgggtacagagattcccggcaccagtgccgagggcaacatcaccaccatctgggtgccggcgatcaagaacatcaaggccccgaccatcatcgagctcgaggccggcaccgacatctcgaactacgtcatgcttggcggctggagcttcgacccgtcgcaggacaccgtgtccgaccagcgcgagaacaccgtgcaggacttcggggcccccggccgcaagagcgccggcgacatcagcatcgaggtcatcgacaacacgaacacggagcacaaggaacagaacgaggccgtcaccctcatgcacgagggcgcgtccggctatatcgtgcgtcgccgcggcatggccaccgacgcgccattggcctccggccagaagctcaccgtcgtgagcgtgaagtgcggcgaaaagaaggtcatcaacccggatgcgaacaccatgatccgcagtcagatcccgctgttcgctcaggctcccggctgggagtccgagaccgccgtgctggccgcagcctgacaagttcttccgtgcggggattctaagcctttctggccccgcacaggcattctctcttctctctctcagaaaggttttcagactttcagaaagggataatcatggctttggaagtgaagcgcaagcgcgtggacgtcgacctcatattggatcaggagaaggccgaacaggtcgccgcattgggagcagacctggaacgcgccatggcgcagcatgtgaccgaaggcggcaacgccgccgccaaacgcatcgccgaccaaatcgacaggctgcgcgacgaggtgaaggacgacaccgtccgcatcaccctggaggcgctgccgctctcccagtggcgtcaggtactcgaggcgaacaccgtcaccgagaacggcgtaccgaaacaacacatcgaggacatctgcgccgacgccgtcagactcatggtcaggaagaccgtgccggaaacccccgtggaagagctggccaacgtcatgaccgaactgtccgacggccagatcagccccatctggtacgcgatccgtgacctgaatgcgaagctcatcgacccaaaagacgcactcgaatcagcctcgcggataatccgcagacagtaagggaactgcgaatctgccagaagctcggcatcagctacaagcgttggctcggctgggaaccgtcgtatcgggtggaaagggacgggcataggcgcatcaccggctacacgccggaaaccgaatgggatgcgaccgaacgcgaatggatgctcgcactcgacgaatacgagcgcacgctgtgtccgcgctgcgggatgcccgtcagcatatgccacgacgagctggcccccaccaaatacgcgagcgaggtcggcgtctgccagatcgacctgatgcgccgcatcgggctcgaagaataccgcaaggaccattccgcggaatccgccacgaaacttgactcactgaccgtgggcatcaacccacgatgatccgacaggaggatatgccatggccggtggcctgaaccgcaacatcaccgtccgcctgctcgcggacaccagcaatttcaccgccggcatggccaaagtgtccggcgaaagccagaagaccgcgaccaccatggaagccgccggaggcaaatcgaagctcatcaccaccggcatcgcggcggccggtgtcgccgccaccgcgctgggcgtggccgctgtcaggatggcggcggacttcgacgccagcatgtcgacggtgcaggccaacaccggagccagcgcagatgagatgaatcagctccgtcaggccgccatcgacgccggcgccgacaccatatactcggccaccgaatccgccgacgccatcaacgaactcggcaaagccggcctatcgacctcggatattctctccggcggtttgagcggcgcattgaacctcgcagcgtccgacggcatggccgtaggcgacgccgccgaactcatggccaccaccctcaaacagttcaacctgacgggcgccgaatccactcaggtggccgacgcgctggcggccggcgcaggcaaggccgtcggttccgcccatgacctcggcctcgcattgaatcaggcgggtctggtggccaacagcatgggcgtcagcatgcaggagaccaccggcacgctcgccgcgttcgccaacgccggcatgataggcagtgacgcgggcaccagcctcaagaccatgctccaacgactggccagccccaccgacaaggcgcagaccctcatggacgagctcggcatcaacgtgtacgacgccaatggcaagttcatcggccttgccggtgccgcaggccaattgcagaacggtttgagcggcctgagtcaacaggaacgcaatgccgcgctcaacaccatcttcggagccgacgcggtgcgagccgcgaacgtgctctacgagcagggcgcggaaggcatcgacgactggacgaaagccgtcagccaatccggctacgccgcggacctcgccgccaagaagaacgacaacctgaaaggcgatctggagaatctgagcggctctttcgaatccctcatgatctctttgggcgagggaggtcagggaccattgcgctccctcgtgcagacactcgacacccttgttgacggtttcgcgtcattgcctgcgcccgtacagcagtccatagtgctgatggcggctctggttggaggcagtgtcgcagtccacaaagcgatggggccgctgaactctagcagcagccagcttgcgcaaaccctcggattgattgccgacccagggcaaaggctcataggcctcggctccggaatcgcgtcagcgttccagacatggggcgcaactttcggcagtgcagaatctcagataaacacgtttggcaccactatcagtcgttcccaaggcattatggccggtttcaaaaacctgggaagcggcatagtatcgttgctgggcggaccatggggcatggccatcaccgccgcaggactcgcgttgttcgctttcgcgcaggatcagcaggccgccacgcaacgagtggacgaactcacccaggcgttgcagagcggacaaagcgccgccgaatacttcaacaaggcgctctccgaaagcgattcgtcacgctacacggccgacatattcagccgttggacctccggctacgacaatgtgcgagaagcactcgacaagatcggcatcgcccacagcacctacatcaaggccatacaaggcgagcccgaagcgattctgcgagtccgcgaacaggccgacagctaccgtgactcgctcggcggcatcaaccagatgtgggaccgcacctccaacgttgcctacggcgtactgagcgaacagcaggagatcttcgagaaatcagccgcagcggccaaggaggacgcggccaactcgaaggccgccgcacaggagaaactggcgcagacgctggccacgtccggattggtcgacgcgcagtcggcgaacgcggacgccacgcaggaatcagctgacgcccaatctatccttcaggatggtttgggagcgaccaccgacggcatcaacgagcaggccaccgccttgggcgaggtcattgacgcgctcggaacctactacggtttcgcgctctccagctccaacgcgctcatctccatgcatgactcgttcgacaaggcgaccgaaagcgtgcagaagaacgggcagacgctcgacctgaacaccgaacagggacgagccaaccagagcgcgttgaacgatctcgccgaatccgcgttgaaggcggcggaagcccagtcacgcaacggcgaaggactcgaagcggtcaacggcacccttgacctggcacgcgagaaatacatcgcagctgcacatgcgatgggcatgaccccggaagccgcagaagccgcagccaacgccgccggcctgaccaaggacaagttcgaccagctcgccaccagcgtcaacagcatccccggatccaaagccatcgacgtgaacgcccacaccgaaccggccaagaacagcctgaccgacctcggcatgacggtggcgaaacttcctaacggcgaaatcaaaatcgacggcgacaacacacaggcactcgccgccatcgaggcggtcaacggcgtcgaagtggatccgcacaccggtgtcatcaccatggacaaaagccagtacgacaccgccctcgcattggcgaacggagcgacgatcgatccgaagaccggtcatctgatgggtgacaacagcgactattggaagaagatagccgaagcgaacggctggaccatcgacccgcataccggcatgatctacgcggatgacggtcaggccatgagcgtcatcaccaatctgaacaacacgcagatcgcggacaagtacttcaccatccatggcagctacgtcgatgattcaggcggcacgtattcgtccagtggttatcgtccggccggtgcgatgggcaatatccccaccggtaagaccggcggcctgttcaccggttatggggtttcgatgcgcggctacgccggcggcggcagtgtcatcgagggcctcctgccaggcaaggcgagcatcacgggcggcgacaacatcacgttggcgaacgcgcgagtcaagagcggcgaattcgtgtccaatgtgaaatccgtcgcatattatggcgccgacacatacgcggccatgaaccgccggcagatacccaaggaatcgttctccggccgggatatcgacgtgagcggcgtcatcgaggagatacgttccttccgcgagcagatcggcccaatcatcagcgcgtatgccccgcaactcggcaaacgcgacttacagcggctcaccaaggaggttttgcgcacatgatgcacacgctcacctacacgtcaaaccgcgccggaaccgtgattgatctcgccgacccggagggaatcatgtgcggacagatcctggagctacgcacccgcacgtgggagttcgagctcggctaccggtcattgcatgccacgcggcccgcgaagaccgtcaaggtcaccgggctcgtctacggtatcccggcgctcgaaaaggccgaggaactgttcgacgcggacatgtacgcctacctcaacgatgccgcgaaacccggcgtcatcacggtggacggatggtcacagacctgcctcgtggtcggccacgaacctgactacacgtcacccctgctcgtgcgcggcgatttcacggtcgccttgcttgacggggtgtggcacaaaccggtcaggcagagcttcagccggtcgacggcccgctacaacagaggcaaggactatccctacgactatcgctacgattacgcgccgacccgcaacgtcagcagcatcgacaaccaatccgccctgccctcgcggatgaggctcaccatttacgggccggtctctacgccgagcatcatcatcggcggcaacaaggtgatagccgacgtgagcgtcccatccggcggctacctcatcatcgacggcaccggctcaccacgcacggccgtgatggtcgccgccaacggcgacatcaccaacgtgttcgacaaaacgcatcgcgaccaggcctccaacgaatacgcgttcgccaccctcccgccgggactgcagcaggtctcatgggatgaatcgttcgggttcgacgtggagtactggttggagcagacgggactgccatggacctgatctggaccaacaccgctcacgtgccgcagggcgaactcgtctcccccgcactcgacctgcagtacggcgacgagcagaatgatttcgaactcactcactccacccccggactgctgctctccgacggctgctacatcggggcggaaggcaccgagttcggaggccgcgtcgacgcggtgcgtatcactgtggatgacgggcatgccctgtatacgctcaccggccgcacatggcacggtttgctcgcaggcaagatcctccaacccgaccccggcaccgaccggctcacggtctccggcgacgccaacaacatcatccgcacgataatcagccggatcggactgtccacggtgttcgacgtgccctcggaaacgagcggcatcaccctcagcaactattcgttccgccggtacattaccgcgtgggacgggttgcgcatgatgctcaccgcgcagggagccagactcgacctgacctacaccgctggacgctgccggattcgcgcggtcgccgccgacacgtacggcgacgcggacagcgaccagcgcatcagtttcgaggcgcaacgcatctggacccaagtcaaccacctcacgggcctgggcaaaggccagctgcgcaacagggcgcgcagcgactggtatgcggatgcgtccggcaacatctcccagacccagactctgaccggcgaccgggagatagctcagatctacgagctcacatcctccgaaggcgccgaattgtccgaccagaccagggacaagctcaaggacatgtggaaacagggcaccgtcgatttgacgatccccgagaaccttggcctgcatatcgacgaccatgtgcgcgcctacgatgcgctgaccggcgtcagcgtggacagccccatcgtgcgcatcaccgtcaaactcgccaacggcacaccaaccatccgatacgaagccggccaatacagttggcccgatgaacaagactaaaggagcatcatgccgaaacagcccaacatcaccctctactcctgtgatcggccttcgtgcgtcaacaaggaatacgtgttgcccaacgcgacggccagccccaactggcacgaggtcacgcgcgtcgaccgcaacggcaaccagaggaaaatccttttttgcgaatccgactaccagcagtacctacagttggccgaaaatcaggacaaggattatgacctctggctcaacaagtccctcaacgcggaaggtaagtgatcatggcaacaaatctgcttgtaaccggctcgcacggcggcgacgacccgcacgtggaatcgaagcatgacgcgctcatgcacgccgccatgctcggccgaggcggatacattttgaaaacccggaattggacgatgaaaccgacggcgaaggatgcgaacaacatcaccatcccagcatgggacctcgtggtcgagggccggcagatctacatcgccgcaccgaccgacgtgaacatccaatccggctcgcaagggcaaaaacgacgcgatctcatcgtggcccggtacgcgttgaactcaggcaccggcgtggagacggtcaccctcgaagccatcaagggcaagcccagcgcggccacgcccgcggatccgggcatcgagaccggcagcatcatcggcggggccatcgtctccgacctgccactctgccgcgtcaacctcgacggcatcaccatcacatcgattgacacgctggtcaatgttatgcagcccttggaggacgtgtgggattccctaacccgaatgccgtatattctgtgcggaggccatttgggaattatttaggggaggttttgggagaataaaggacgcttttgaggaataaaaacgagctcgctcacatcgacgagctcggtcaggccctgaaccagcattacaggccggcacagtcgcgcttcagcggcgactccgaccaatgattttcccgatccttaggccgcaggcccttttcataaatccttttataactgtttcaggttccgctcagccctactgccgcaagggctaagcagctaaaaaagaacccaaaaggggaattcaaggagatgacggaaagtgtactttaaacacaaaatctgtgtactttggacacacttttttgaattcgattttctaagtatctgtatatctgtctatctggcacaccctctcagccctactcccacaagggctgagagggtgtgcgtgtgtttaaagcccctcattttgtgtttaaagcccctcattttgtgtttaaagcccctcatctgtgtccaaagtacacacaaaatctgtgtactttaaacacaaaatctgtgtactttggacacaccatgctaacatgtgtccaaagtacacagataggaaatgctcccgcgagacggcaatctccaggagcttggaaaccacgaaagtgagtcgtgattacatgactgattctaaagagctagttgtacccagtgatgacccttggatgtcacatgcgttcatctccaagatcgcagctcaggtatctttgccgtatcggcgccaggagatgcacgagatcgtcaagcgcaatggttcgcttgaggtgcatttcatttgtggcgcggactgtttgccgtacggcaagtaccctcgtttgttcgaactgtgggcgtgcacgatgatcaaaaccggtgatgactgctggaatcccgaaacgcgcacgttgaacctcggttcgtcgttccgtgactttcttagactgttgaacgtcaatgtcggtggtcgtcagctcaaggttatcaagtcgcaattcgaacgactgttccgctgcacgtatcagattctcaatctgaccgacccgaatcagacggacatggcggcgttcgtggtggctccccgcgtgcacatcgactggctgaacgaaacgaagccactcaagcgtggggagaaagccgataattgggtgacactgtccaaagagtacgtgcgcatgcttcaagacagtcctgtgccggtcgacctacccacggtggccaagatcaaaagcccgatggcattggatgtgtattggtggctgaccaagcgctactacaacatgcacgaccgtgtgagtatcaagtggcagaaactatatgaccagttcggcagcgattcggccatgaaccagtttcgcagaaacttcaaacaggccgtcgctgaggtgctggaggtgtatccggcggctcgtattacctgcgggcgtgagtatgtgacgttatggccgtcacagacctcagtgccgactgtggcacagacgtgcatcgcggaacatgcgtctgctcgcacagtggacgcgcagataaaagatgcggaacgtgcagtgcaggcagaggaacgtgtccaggagcgcagaaaggccgcggaagaacgtacagagcgtgaacttgcggcggaacgagccagggctgaactggatgcgtataaggcggcccacgatggtctgacaccattcgaggtggccagacgcagccatgattcacaggccatgcccgatgatcggatggagcctggtatcgagccgactcttttctgaacaaggggcctgccgcgggctccgacccgcggcaggttgcgccgtcaacggcggctggatgccatcgcccagacggccagggccgtcacggtgatgtcggccgcgatgggatccatcgcgggagcgaggcagatgacgatgaccgccatcagccatatccagggccggccgtgcggccccttgttacccatgcgcatgtgctgcgcctttcgttcgggccgcgccgcgactggcgcggcagcgtcgcccggcggatgccgggcggtcggttttcgtccctgctacaagacgtccatcgacgacgccaatcgtatcggctaagatggaaacgccggcggaggcgctgctaacttcccccttacgatcaggcgggcatgcatgacttttcggggatggccgatgccggcgggatgggttacccgccatcccctttgattgggccgtggccccgcgtcttcggatgcggggccggcgtcttcaaacaccaaccctttgcattactggtctgttcaatccaaggtccaagagctataatttccttgtcagacgcacgtctggcatacctaatcaaggggggcaaaaatgttacgtaccaagcatttgaagatggcagtggttccaatgactctgctggcgctcctgtcgacggcagtcccggtggcatctgctcaagaaaccactgacgagtcgttctatgaacttaccaccactccgtcgggcggggacatgattgtcggcgaacctggcacaacgattctctttgattccagcaacggcgaattggtggacgtgctgccgccgagcgaggctgaagattattcggtaactgtctcgcgtggatgcgctgattccaatgctggatgctgggctggcgggacctctttgggtgacatgcagtttgcaggcaccggaacggcaacggggtcctggccgtatcgcaacagctatacgaccggcaataagtcgggacagatcaccttcgcaatcaatggagttacatacacccctgtcgcagctggtccgtggatgcgcatcgccacggcagacggctctggcgtcgacggcgtatccgttacccgctggtaaggatgtctttctaaatttcgggccggtgtcttcggatgccggccctttgcgttcccggcgttctcacaggccgagtccgtggcctcccgtgccccagcccatgccgatgttgagcgggtcggcggggtcggagaggtcccatgtctcctccatgtcgggttcggcctgtttttcggcctgtttgcgttcgttttcggccagccgctcgtcaagccgtgtcttgaacctgtcggtgagcgcctttttcgtcctgatgggcttcgggggttcctgcggggcctgtggcggcgtttcacgagcctgcgggcgttcctgtggcctttcggccggttcagggcttgaaggggcctgtggcgcgcctgagggccgttggcggcgtttgacggccgtcaggatgccttgcgcttggtcggagagccgcccgatcatggccctaagcgcgtcgaggagccggttcagggcctggatgcgccggttctcctcgcacaggtcgcccctgccgccgcgtttctccatctcgcggctggcgtatccctcgtggatggtggggatgcgttcgatgccccgcgccttgaagctccgatggtcgatgacggcgtatccggggagcagggcgttgcaggagtcggcccactcgcgcctgagcctttcgaggaactccttggagtccaaggggttgttgctcacgttgacgcgcttccagaccttgcggtttctggcgccgatcttctgccgtccggtgtcggggtcgatgacggggatgcgccggccgttggcgtccaacgcgaactcgctgcggctcttcgccgcccatctgccggtcttcgggtcgatgcgccggttggcgacgaggatgtgcgcgtgggggttacgtccgtccttgtcggtgtggatggcgtacgtgcaggcgtagccgttggccgtgatgttccatgagatgaagtcctccagtgcgcggaagcgttcgcgggcgtcgaactcgcggggcagggcgaccatgatcttcttcgcgggcctcgcgtcggaacgtttctcggccatctcgacggcgttgaacaaacgctccgggtcgaggtactcgccgggcgcgccctcgggcagcatcgtgcatacatgctcgacgcgctccctgcggccgaacccgttgaacgcctcgccggtgcgctcgtcgcgcatccgacgcgaggtgatgtacgagcaggaggcgacggcgctggagccggcggcacggctcacgttcgacacgtgcaacgagtagatcgccacgggactgtactcctttccgggaatccaaagggccgggaggcccgttggccctccaccggggaggtggccggcaccccgccgggacggggcgcggatccaagcggcgcacgcttggcccccacggagtggcccctcgggagagcgcgcttacgctgaatgttaccaccggtaacatgtaagtgcgccctcaatgaaattgagggacttccacctgaccttgcggggatggttccgttaccggcgtgtcggtcgacgcatagagcggtgcatggacgaattttctgatgctcttatgcaatgggcttggcgattcatgggattgatttacggggagtttcctgagactgcggcaaggctgatcctctcggctgctcttcgcaagctgccgcagcttgcgaagaggcttttccggtcggtgtttccctcccgtggccgtcatgcgcgcggaaatcggcgggggcggcacgttcggcattgatgaacgcttcgccctcgcggcttggatgtccaaaccggctccgttcttccgggtttaggtttggtgtgtagacgccgtgccccgtgccgtgctgccgtggggtctagcgtcctgattgataaccgacggaacgcagggaggaaccgatgaccaggagcgtcgaggagcagatggccgacatcgagcgccggatgaagcagctcagggcgcgcaaacagcgcatcgtggctagggagaacgccaaggcgcgcaagcggcgcacccatctgatcatccggctgggcggcatcctctccaacgagggcgtgcttggctacgacgagggcgtctggaacgacgagggcaaccggcaaaggctgctggacatgctcaaggcccatgccgccgaactgcgcgcatgggcctctgacgcgggcgtgaggctccccagcgctgagtcggcgggtgagctgcgggaacaggttcgtgacctgccccaagagcctcagatacaggagcagccgggctatggctaccagcccggattccaacagccacagcaatggcagcagcagccttggaactgagtcggtttcttctcttcatcggggcggagcccctttttatagaatcttttgtactcttttagactccccgcaggccttacggcagtaggggaaacgcactattaaaggggagaaaatgggagattaaaggggagattttgggaattatttaggggaggttttgggaattatttaggggaggttttgggagaataaaggacgcttttgaggaatactttcaggcccgcagcccgcacccgcagcgtctccggcatggccgacgtcttccgctccgatcagacgggggaatggtccaagaccagcgtgagcatgaggcccgaaacgcggcggcggctcaagacctacgccgccgcgcacgacatgcgcatccaggaggtcatcgacctcgcgctcgaagcctatctcgcatgacgcgagacgccgtgcgaaacaagcaggtgcccgaaccggaacggtgcagagcgccaccggcggcggcatgaacgcgcggaaaccggcaaccccggctccgacagagaatgaccgaaataccgaaaccggtaaaatcggtgcataccgaaacgaacgatgaaaggacacgaatgaaaacggaacaggaaacggaaaccaacaccccgccgcccacgaacggagaaaccgccgccgtcgaggagtcgaggcgtgttcggccgaagtggctggtgccgctggtcgcgggcctgtgcgcgctggcgcttgtggtggccggcggcatcggatggaaaatatggtcggaccgccgactgtccgaggcgaaggccgcgtgcgccacggcctccgacgcggcgcgcggcgcgatgaacgactggaacacgctcgtcaacggcgacgcggccgacttgctggaggtcaaggccgatcaggtgaaggacgcgaagaccatcgacgcgctgaaaaccgcgctggacgtggaagcgccggaatacgagggctgcgtggccgacggcaaggacgggcttgaaacggcgatcgacgaactggacgatgcggccgcatggtacgagaagcacgccgggagcctgaagaaggcggtggacgcggtgaacgactcgaagctggcgaagaccatcgacacggcgaaaaccctgttggagtccagcaacggcaacgtgcaggatgacaagacgcgcgaggaactgtccaaggccatcgaagccaaggacgaggccgcgatagccaaggcatccaaggcggtgaacgattccatcgcggcgaagcagaaggccgacgaggaggcgaaagccaaggcccaggccgaggccgatgcgaaagccgccgccgctgcgaacgcccagacgcaacaacagcagtacaactatcagcagtctcagccccagcaatcctggacaccctcatacccctacggcggaggcgccactggtggcggaagcggcaccacgggaggttccacaggcggctccgccggttcctcctacggcgggagcttcggctacagcagcggctatggagctgctactccgggcggaacttgcccggagagcgtgtgcggcgtctgacttgctgacatgcaggcatgaaactcgtccgattcgttcgggcgagtttttttatcattcgcttcggtatgcaccgattttaccggtttcggtatttcggtagataccccgaatcatgcgttttaggcgtttcccttcctcgtggtcaatatctcgcgtaactgatcggaaaaaatgtccaaactggaccggccgaaatggggttctaatggtttgtggccggagttttccggactccggctaccggcttttaggccggtcggaaacaagaatctaacaggaggaaaccctatggttttcaacgagaggaaacgggctgatgcccgcaacgggaaggggctgcgcgtggcagtggccgctttgactgcggtggcgacgctggcaggcggcggcatggtcgcggccaccgcgatggccgacggcggcggcggctgggctcccggctcggctggcagtgtcggcggctcggtgatcggctgggcctatgaggacaacaacaacggcggtttcggcggcgctacccttgacgcgttcaagaaggccgtggcgaagatgggcgcgacctataacaactacaacggcgtggccgatgagaaggcgaacaccgcgatcacgatggccaacaatgaatgcgtggcccgtttcaacgataagcatccgggcgagaccgcgaactgccgcatggtcgccgtcggcgtggtcgccacgcccaccacgcactcctattccggcgaaggcttcgccgacgccccctattggagcgacgcatggaacaaaaacatcgcaccggttaaataccacaataatggtgcgtcttatgacactgacgacggtttctctgatgctcctgagcgttcggtggactcgatcgcggcctcccagtggaataacagcccggttgcgatcgtcatcatgttgaaccaatacgagccggtgcagccgaactatcacttgagcgtgagcacgcaggctgcggagatgtcgggccagtcgggcgacaccaaggacgcttcggacacaatcaccctgtccagcgacgggtcgaagaccgagaacgtgaacggcaccgcgaccctgcactggcgcggcatcgacggcaccgagaagacggtggcgaagcagttcaccgcatccaacaagggcaacgccacagtgagcgcgtccttcaaggacatggacgcctcgtgggagtcgtggcctgcgggcaagcgctggtgggacgttgacgtggcgaagcagggcaacatggccgaggcggtctcccacaagggagagaacgacggcaaggagtccggcgagaagaccaccaccccgcccgagaaatggctgaccaacgaggccggcgacacggtgcgggacggcaacgactccatcgcgtccggctcgctgtacaccgcgcacatcaaggcgcattccaacgcctccggcaagttctggatctacgacacgatcaacaccagggacgtggtgatcggcggcaccgagcaggacgacgtgagcaaggtgaccgtgaccgacgcgaacggcaacatcgtgccggcggacatttccatcgacgattccatcgatggcaagcgcgtggtcaaggcgcacgccaccgccccgcattccggcctctacacgctgaacgtgccacagtcggccaagcccaccggcggcgactacaagatcaacgacggttccgtggcgtgctggaacggcgacaacggcaccggcagcctggccgactgccagaccggcaacagcgacagcgtgggcaaggtcacgccgaccccggacaaggtgtgggtgctggacgagtccggcgctctcgtggccgaggacaagcaatggaccaaccagcagggcgtcgatcagaagacgttcctcgtgggcgaccaggtgggcgtggtcgtcaacggcagcatccccgcgcacctgctcaacccgctggcatcctattccatcaccgatgatctgaccggttcgaaccagtggatcgactggaagtccggcaaggtgttcgttgacggcaaggacgagaccgaccagttcgatatcgtgatcgaccggaaggccgggaccgcgaccgccaccgcgaagtccgcctacatcgcgaagacgatgttcaagaacagcgcgagcaaggtcaagttctacctgacgggcaccatcaaaaagggtgccaccgagggcaggaagatccagctgaccaacaaggcgtacgagaagtggaacaacgagacccgaccgaccaacgagcccccggtgttcgtgtggacacccaaccccaacaaggcgtgggccatgaaggtcggcggcaagtggcagctgaccgtcgatccgaccaaaagcgacaaggtgggcggcgacgacaagtactaccgtctcggcgacgaggtggcggcggtcatctccggcaccctgcccacaggattgggccgcgtgcccgagatcgcgtggaccgacgacttcgccaacgtcgatagcatcctcgacctgaaggacacctccaacatcaaggtctacgagcaggacaccaccgacgaggccaacgccggcgtcaacgacctgaacaagaccggcaaggacgtgaccgaccagttcgacatcaccgccgagggcaccaaggtcacggtcagcgcgaaggactcctacgaggccgcgcagaaggacctgaagaccgcgaagcagatcagcgtcgtgatccccttcgacgtgaacttcgacaccaagcagctgctcgaatcctacggcaaggcggagggcgacgagctcaacacgtgcgttgacccgaagggcgacgacctcgacaacaagggcggccagacggtcggcggcagcacggtggacaccaacacgccgaagatctgcgtgaccgtgcccccgatccacaagcaggtcatcgccgaatcctcccagggcggcgaccagtccagcatcgacaccaagaccgtgttccccggccagaccgtggaatacaccgtgcgcgtggacccgcagatccccgcggaccaggcatattcggtgaccgccatcaagctgagcgacacctattccgagtacaccaccgcgaacaagcaaaccctggagatcaccgacctgggaaccggcggcatcatcccgaagagcgcctacaaggtgcagtgggacgaagccaaccactcgttcgaggccacgttcaccaaggactgggttgccgccaactggaaggccggctccaacccgcgcgtgctgctgcgcttcgaggccaaggtgaacgaggacgcgcccaccgacaagaccgtcgacaacaaggccgcgctgaccgtcaacaacggcgtcaccccgtccaacaaggtcgagaacgagccgccggtcatcaagccctccaagcaggacacgcagaaggacccgaccatcaacatcgacggcaagaccgcgctgctgggcgacaaggtgtactaccgcgtcaacatcgacgcctccaggctcaccgacaccgcctacaaggtatggcgactgggcatgacggacgactacgaccaggagtacctgaccctcgacgcgaagcacgtggagatccttgacgagaccggcagggaccgcaccggcgagttcaacatccaggacaaggacggcgtgctctacgccttcgccaggaccgttgacaccatgatccccgcgaccggcgagaccgtgcccggcgacccgcaacccgacgacctgaaggcctacagcgagaaaaccgacaaggattacgacccgctgaaggacccgagcatcgaccagtcgctgctgggccacacctaccaggtggtcatgccgatgaccgtcaccaaggtcaaggacggccacacggtggagaacaccgccacgcaggtcacgaacgacaggcgcgacaagaccaacaccgtcaccaacccgctgaaggagatcaacccgaagaaggacgtgaccgtgcaggtcggcggcgacagcatcgacggcaagagcgtgtatctgaaccacacgttcctctaccgcctggattccagcatcctgcccccggaccgcgcctaccagaccgtcacggactggggcggcacggaccagctgaacaccgagtacgaccagtacctgggcaactgggccgtctacgcctcgcgtgatttgtacagggacggccaggtgctcgcggccaggggcgagaagatcgcgggcagcggcttcgactcctcgaagttcggcggcaacctgttcaccgtggacgccgacggcaacggcaaggtcacggccgacgcgacccaggcctacctcgacctggtgagcgccgacaacgagcacgaggccggctggaggctctatctccagtgcaagcgcatcgccgtggccgacgaggtgcccaacacgtggaccgagaccatcaacggccagccgcgcgaatccaacaaggtcgtcaccaagaccccggacatgaccccgagcatccacctggagaaggtcgataccccgaccctcaagcaggacggccaggagcgggcggaccgcgacgacccgaagcaggcgctgaagatggacgccgacagcatcggcatcacgttcatcatcacgaacacctccaagaccgacccggccaccggcgacggcgcatggtacaaggcaagcgacctgaacctcgccgactccaccatcgtcggcgacgcgcacgtggacatggattcgctcgcctaccccgacaactgggacaccctggtgctcaagccgggcgagtcggtcagcgtgaccggcacgctcaagggcgtcagggaaggcgatacccacacggaccgcgccatcgtcaccggcaccccgctcgtggaatgcgcgccgtccaacggcgacccgttcaacgacaagaccgacggcggcgaagacaccgatccggaatactccaccggcgacgtgaccgagatcgacggcaagcagctgtgcgccgacacccagaccaccagcaacaccgacgactggaacggctaccgtgccaagccgttggcctccaccggcacggccgtgctcggccttgccggcggcgccctggcggtgctgcttgccggcggctccctgctcgtgttccgcaagcgccaccgcgcacagggttccggccgccacacggccgtgaacgcgggcaagtgaccccgaggcgttccggcctcgtcgtccgatgacggccggaacgccctccattgacttcacatgaatgaaccacagacttcgccctccccgacgaatcaccgccacccgaccggagacggtcggacggcgtgagccgggaaggacgaaaaccgggggacgggtcccgggaactctcctgcaaaccgtacttgggacccatcctccacaccattagaacagccgtattcatacttccctccacttgtcacggcacatccccgaaaggaaccgaaaagcgatgaaacccggtctgagaaaggtcgccgcgctcatactcgcgaccgcgacgctgttcggctcaggcgcgtcggccgtgtccgccgcgtatgcggacgatacgaccatgggcacgtccacgcgaatccaagccgaacccgacaagacgaccacaggcggcgacgaggccgcgacgaaacccgacgccggttccggcgacgaggccggaaccggggcggacgaacaatccggcaccggtgcgcccgcgcaatccgctccgcaggcggatgcgggtcaggccgcgccggacgtgaccgtccacgacatgctcgacacggacagcgccgccgtgagcaggctcaggctcaccgaccgcatcaccggcaccgcgccgttcgacaaggacaatgaacgcggcgacgacaaggacgaaaccaacgacatcgtccgctcctacgatacggtgacctacgactacgagtacacgctcacccccgactcgaccatggactactatcggcgcacgcgcgtcggcttccggttcgaactgccgtatccggccgataaggtcacgttcgacgcggagaagatgggctgggtggaccatacgcccggctacgagccgaaactcaccacggaaaccatcgacgggattgtcacgcaggtgtacacctgctaccgtctgttggagccgaccagccagtcgccgaccgtgaacccgggcaccggttccatcggcctgtcggtcgccgtcaagggcgcgccccacggctaccggttccatccgaccgtcaaggcgtggaccgcatgggacgcctcgaacccgacgaacacgggcacgcacaaacgggccgaggacacgccgaaggatgtgaccgtcagcgcgaaactcaacctgaacgtgcgcatggtcgattacggcaacgtggacaggggcgtgttcgacttctcctcgggtgcggcgaacgcgcccaacaggacggagggcaaggtgaccggcttgggtttgggcgtcgcattggtcacggagatgcgttggcccgaccggacgaaggggttgaagggtttggaggctccgtccggcaggatcacctataggcttcgcttgtccaaccagtattcggatgatacgaaggccgggacgaagcatccgatggaacgccgttggcagccgttgctctacgattacgggcatatcgacaacgaagattcgaagtatgggcggacgttcgcatggatgggcgacctacgatatagggctccgggcgtcgccgaccgtgccgacgggaacgaccgtgtggcgcgtggcgacacgacggtcacgaccacgaccggcgggcagggcacggacgtgaccgtctcgttcgacggctacgacacgtccgtcttccccatccacaataaactgaacggcacacataataaatgcagcacggattacatgacgtcggactgctccaccatgcaggtcggagccatccacacggacgtgttgcagttcgtcacgcccaccagccgtgacggccggaccgtggcgcaatattacgggaacgtggaccagacggccaacatcaccatggacgacatgggattgacggccaccggcgtcagcggagaccgtctcgccacggcggaagacaattcgaatcaggccgccaccggtgacgaccatgcgggttcggccgtgaccgtccgcatgccgggcacgtacagtacgcgcatccgatacacgtgctggaacaacgaaggctcatggaacgatgcgggcacgagctgcgactggacgatgcccgaccgcgtcaacgggtccgacagtctcgtacaggggtcgaaactacgcctccaaataggccacaacatcatcatccagtccgaaggcgacgccgaagtgatgggcatgggcctggtcaaattcgacccgaacagcatcgaaccggtggacgaccatcccgacacgcagccgaccatccccatgaacgtttggacttggggcatgagggcagccaaacggaggaacgcaatcccctactggtacgccgtcaaaaaggacggcaccaactggaaggactacagggagcagcgcgacacgaaaatcagcggactcgactactatccgaccctcaacgaggcgaaaacccatggcacgatagtcggcatgctgttcgaagaccacaacacggtggacccgaccggcacgagcttcaaccgaacattcacgcccatcgtcgccctgcccgcccgcatcctcgacaccgcgagaatcggcacggtcgcacccatcgtcgccgacaccgcctactggacgcgcaagaccctcgcccggaccgcgaacctgaacgtggacgcgccggacacgcaatggcagcaatggtccgacagtctcgccacccgactgcccgaatgcgcgaacggcgtgaaacccgacctgacctacagcggcgacacgtaccggcccgccacgttcgacgaaaacggcgtctatcagggcggcgacaccgccgacttcttgaaaggcgacagcctgtacatagccggcgaaacaccgcacatcgccaaacaggtcgagcaaaccaacgaagccggcaacgttaaaaccgtctacgatttggacaaggaacagcgtgcggtggactggaagctcaccgccaccgccgacacgtccacgaccacggacggcggacaatacacgaccgactacatcatcaccgacacgctgcccaaaggcctgacctacgtggacggttccatgacggtcggcggccaatactcgcagcatacgcccgacaagggcacggtcaccggcggcacgcccgtcacgccgacgatcgtcgtgaacaaggacggcgccaccaccatgaccatcagggtgaacggggcgcgcgccgactccggcacgcagaccgtcatccactattccaccaccatcggggacgcgtccgaccccgaccatgacgtgaggaacaacgattcgttcacgaaccatgcgaccatccagtcgaaacgcaacatggctcccccattggctccaaaggcgcagatagccgacgcgacgatacgagtcagccgcacgcgcgcgtccgcgttggcgacccgcgccgacccgctgctgaacgacatcaaccgcccgttgggattcaggaacatgctgggcaacttctccaaggatgagaaaaccgacccgtatgcggtggacgtcatgccttacaggggcttgaaccagtccaactatcacggcgactacactctggccggactcaccgtcaaggcgggtgcgggtgcgagcatgaacggcgtcaaagtctacttcacgaccgaccagaagtggcgcaacgtggacgcgacgaagataacccgcgaacaggtccaacaatggaccgaagccacggtgaatgcgaccacaggcaaggtgaccatccccgacggctacagcaagccggtggcgtgggcgttcacctcgccaagcctgcctgccaacgcccgctacgatttcatcctgagcatcaagcctacaggcaacaaggcggcggactcgtacgtgaaccggtgggcggacggcgacaacaaggtggacgcggtcacgcaggtcgtggaacgcaaggtcaacggcgtcgcatggttcgacctcgaccatgacggcatccgacaggattctgaccggcttctcgcggacgtgaacgtcaccctcgtggacggcaacggcaggaccgtcaccagtgtggacggcaaaccctgcaccaccacaaccgacaggaacggccactacgaaatcggttccattccggcaggctccgggttcaagctcaggttcacgccgaaaaccggcaccgcctggcacgggcagaacgtcaccgtcaaaaacgcgaaggaagcgtccgaggcgaccgactccgacagcgaccgggagaacgattcgcacggcaacatggtcgccggcgtcatcacgctgaaaccgttccccgcgttggacgagatgacgtccgccgtgtacgaggacccgaacgaggaccacggcatgagcggcacgctcatgctcgccacgcccgccacgttcaaagcggtcaaagtattggacgggcgtccgaacggcgcttggaccgacagggacaggtacgtcgcggacatcaccgcgttggacggcgcgcccgcgaacgcggtgccctccaccatcacgttcgccgacaacaggacgcagacgctccagatcaactccaacgctttcgccaaggagggggtctaccggtatcaggtccgggaacgcaagggagacaatgcgggagtcgcctacgacagccgcacgtgggtcctgaccgtcaccgtcgccgatgattttgacacgttcacccgtcgcatcaccgccaacacgacgtgcgacggcgtgcaatccgacgccatccagttcacgaacacgtacgcgccgaaggacacgcaggcgcgcatcacggcgagcaaactgttcacggacgcggacaggtcggccacgaagattacggacttccaattcgacctgtacgcgaacgacaaggcgaccggcacgcccatccaaaccgtgaacgcgacggcggacggcagggtcgagttcgccccgctcctgttcaccaaggcgagactgaacggcagggacagggccgtgttccgctattccgtgcgcgaacgcaatacgggcgctgcgggagtccaatacgacggacatcatgcggcgtggacggtgacggtcacggacgacaacagtggccagttgaaggcgatcgtcaccaacccgtccgaaaccgaaggacggttcgtcaactcgtattccagccagcccgtcacggtcacgccgaaagcccgcaagacgctcgccaatccgtccggaaccctccgcctgttgaacgccgacgagttcacgttcgaattgcaggatgcgaacgggaagaccctccaatccaaggcgaacaaggccgacggcacggtgacgttcgacaaaatcacctacgacaccgtaggcgaacacgattatcgaatcatcgaacagtcaggcaaactggcgggcatcacctacgaccagaccgtgcatatgatgcacgtgacggtcaccgatgacgggtacggacagttgaaagcctccacctcctacgacaatacgagcaagaccccggtcttccacaacacgtatcagccgaaggacgtgaccgtgagcctcaccgcccacaagacgttcgacaacgccaacaacagccacgcgaagctcaccgacttccaattccaactgttcgacaacgagcgggcggtaggcgtgcccgtgcagaccgtcaacgccgccgaggacggtaccatccgcttccagccgttgacgttcaccgccagccagctgaaaggcaacaagtccaagacgttcacctatacggtgcgtgaaatccgccagtcggcgggcggcgtcaactacgattcccacatgggaatgtggcaaatcaccgtcaccgacgatatgagcggacagttgaaagcccaaaccagaacgaacgcggcctatccgaccacgttcacgaacacgtatcaggcgcagccggtcagcgtgcaattccgcgcgcacaagaccctcaacgaccccgaccatacaggcatccgactgcaagccggacaatacgagttcaaatgcgtcgaggacaagacaggcggtcaggccggcacggtgaaaaccaacgaccagcaaggcaacatcctgttcgacaccatctcctacacgaagacgggagtgtacgactacacgctcagcgaagtccacggcgacaagggcggcgtcacctatgatgctacgaaacatcatgtgaaagtcaccgtcaccgacaatggcgaaggccaactgttggccgacgtgaagtatgataacggaaccaacattccggaattcaccaacacgtaccatgcccaacccgccacggacaatccgaccgcagtgaagaagatgacctcctccaagggcaacaagtacacgctcaagggcgaagacttcgcattcacgctccaccaacagtccgcgcccgccaacgtgtcgaacgccgaccagacgaaacggaacgaccagcagggcaacatccgattcgaccaactgtcgttcccgctcgtcggcacctacgtgttcaccatgtcggaacaggatacgaccgttccgggcgtcaccacggacgggacggttgcgaccatcacctacgtggtcaaggatgttgaccatacgggcaagctgaccgtcgtatccaagaccgtcaccccgaccaccggcgctaacggcaagaacatcacgttcaccaaccattacagtccgaagaacgtcggatactccatcagcggcgtgaaaaacatcgtcaacacggatacggcaaccagccgcgttccacaggacggtgaattcaagttccagttgaacgcggtatccgcacacgacgcggacggcaacgccatcagcgtgaacgacatgccaatgccagccggaagccaaaacggaacagtaaccgtcaccaacaagggaagcggattcacattcggacaaatggtctacaccatgcccggcgtatacacgtaccatgtgaaggaactcgccggaacggacaagaccatcggctactccactcaggaatacgatgtgaccgtcacagtcaccgaccaagacggcatgctcgcggcaaccgccgaccgtcagaccaatgacatccgattcgacaacacgtacacgccaacacccgtcagcgtgcgactcgaagcgaccaaacatctgaccggacgtgacctgaacgacaacgagttcaccgccgaattgaaggattccaacggcaacctgctccaaacaaaacagttcgcccgcgttccacgcgacgcgcaatccgaatccgataaggagaagaacgtccgcgaaggcgacggaaccctcgaattcgacaagctcaccttcgacaagaccggcgtgtacacgtacacggttgacgaacaggacggaaccttgggtggcgtcacctacgacacaaccagccacaccgtcaccatcaccgtcaccgaggacgcggccagccacacgctgaccgcgaagaccgaatactccaccgaaaacggttccgaggacggcatccgcttcgataacacgtaccagccgcagaacgtgctcgtggaactcactgcacgcaagcgtctgaccggacgcgggctgaaggccgacgagttcgagttcgaactcgtggacagggacggcaaggtcatcgacaccgaacggaacgacaaggacggcgacatccggttcaaaccgctcacctacggtcgtgacaacaacggcatcgacgattgcggcgaacaccggtatgtgattcgcgagaagaacaccggtgaaaagaacgtcacctacgacaagacggaacaccatgtgaacgtcaccgtgggcgacgacatgcaaggcaacctgaccgccaaagtcgaatacgacccgacggacgggaagaccgacaagaccaagggggatgccgtcggggacaagccgtccacgatccccagcatggtcacgaccaccggaacccgacccgagttcaccaactcctacattccaccggtcacaccggccatcgtgaagacgattcgccaactcgccaagaccggcgtatccgcgcccatcgtggtgttggccgcgtttacgctcttgggagtgggattgatgctgttccgccgtcgcggaaaccaaaccgagaccgcgcggcacaggaagtaaggccacggtaggccagtagaaaggccgggcgggagagctgattccccgcccggccttttcttttgcaccggctgcaaggtgacgtcctccctctcggccgaagctgaaccgcaccccgattgttggactgaagaaattcagattcgatgatcggaggtcgaatggcagtcgaacgactagaccgccggacacacattttggcctataacccgcaaaaagggaacgccacacagcaggtgcccccgcggagactatgtcacacgggggcaccgccaaggaggttacattatgtttcttttcaccacatccgcttctgtgttatctgtttccagcacatcctcgtgctcttccatatccgatgggaacctctagcgacccggcctctttgccgtattaccttgccgctttctgcattaccaattatagcaaaaccgccctcgcgaaacgcccgatacctcaatcgggagtaagcgggagcggctatgttatgcgaggtaggaaaggtggatgaccgactgactggagtcgtgccttacccgacctttctcaccatttcaggatttcaggcagcgaccttggcggccttatcggcgtcgaacgggtgggccgctgaaacggtgctcttggcagagcccttctcgccattgtcggaatcccagtggatctcgtgcttgtcatcgtggttgcgccaccagctggacaggatagagccggagatgttgtgccacacggagaagaaggtggacggcacggcagcgagtgggttggttgcgaaggaggtcagggccagggttgcgcccagagcggagtcctgcatgccgacttcgaaggtgatggccttctgctgtgcgtagcggaagcccttcgggtagatcttgtacatcagcttggagaagccgaagcccagcgagtagccgcacaggttgtgcaggatgaccaccgggatggccaccagggagctggccacgaacagcttcggaccgttggcggcaacgaccacgccgatgataagcagaatagccacctgagaaacgataggcagggcgaccgtaaccttctcgatcttcttgccgaagatcatgtggcagatcacaccgagggcgatcgggaagagcaccaccttgacggcgttgaggaacagggactgagtcggcacggacacgtactgagaagcgagcagctgcatcagcagcggaatcatgaacggggcgcacagggtggaaaggatgccgatggagacatcgagggccacgtcaccacgggacaggtagctcatcacgttggaggaggtgccagacgggcagcagccgacgagaatcacgcccacggccagcgggccggacaggtggaagatcgcgcacagggccacggcgacgagcggcatgatgatgaagtgagctacggtgccgacgatgaccatcagcggctgggtcaggatgcgcttgaagtcgtccagcgtcagggtcaggcccatgccgaacagcacgatgcccagcatgtagccggtgtacgccttgccccacaagctggcggccggcacgaagtagttgaagacggcccagacgatgacgatgaccgtaaaccacttggtcagccaatctgcaaaggctttaaccttttccatggtgtttctcttcccttgtttggtgtaggtaacatcgcatgaaactaggcgggtcgcggttgatatgaaacataatgctcacattgcgaacactcacgtaatcatttctgcaatccccggtcgtaccatcacaccgtcgtgtgccttgacttttcatcaatcgccgcacaagacccactcatccacatcccgccatctgagacagcccgcagcctggccccaagaatgaaaccgaccacttgattccatcgcgacacaccgatgagcacacatccgcaaagttgtgtatagtattcacctgttgcgcgaattcagcttgctgaatacggcactatggtggccatagctcagttggtagagcatctgattgtggttcagaaggtcgcgcgttcgagccgcgttggccaccccagtaaaacccttccgttcgcggaagggttttgttttttctccctgaattccccgctcctgggttataggccaaataggcatgccgggaaccaccgcgttgtacactcagggcatatccaattcaccgaacataaggacaaaaggtccgtcatgctgtcttttgagaacgattactcccgcgccgcccatcccgcggtgcttgaagccgtggctgaagccaacaaccatctgtattcgggctacgggtccgacgaactgagcgatcaggccaaggccaagatccgcgaggcctgcggccagccggacgcggatgtgtggttcctcgtcggcggcacgcagaccaaccaggtcgtcatcgacaccatcaccccggcgtatgcaggcgtggtcgcggtcgcctccggccatccgaacgtgcacgaggccggcgccatcgagttctccgggcacaaggtgctcacgattccccagcacaacggcaaaatggacccgaccgaactggacgagttctgcaagaccttctatgcggacggcaactacgagcacatggtgttcccgggctccgtgtacgtctcgcaaagcaccgaatacggcacgatctactccaaagccgaactgcaggctatcgccgatgtggcgcataagtacgatatgccgctgttcgtggatggcgcgcgactcggctacgcgctgaccgccaccggttccgacatgacgctcgcggatctggcgaccatcgccgacgtgttctacatcggcggcaccaaggtgggtgccctgttcggcgaggccgtggtgtttaccaagcacaacacgccgaagcacttcttgaccctcatcaagcagcacggtgccttgctggccaagggctttgtgctgggcgcgcagtttgacgccttattcaccgacaacctgtatttcaagatcgcccgcaacgccaatgaggcggccgatcgtattcgcgaggccctgcgcgtcaagggctacacgctcactttcgaggcgcccaccaaccagattttcgtcacgatggatcagccgaccattgaccgtctggagcgcgaggtcaagctcggctttaccgaaaaggccgacgacacgcacaccgtgatgcgcatctgcaccagctgggccaccacgcctgaagaggtcgatcaacttattgagttgttgtaaaacccttcgctaatctctccctccgtcatcgcttcgcgatgccacctccctcatcagagggaggttttttcgtagctccctctgatgagggggctggccgccgcaggcgaactgggggaaagacctctccgcaaacgagaaggctcctactcccctatcgccttgcgttccatatccacaaacttgtggaccgaggcttccacggaataatgcgccttggtgtattcggcgtatttttcgccccattcggcgcgctcggcctgatgtgcaatccaccaatcgatgcgtcgggccagcagggccgcgtcccgcacggggaacaacgactcgtcgatcagcgcgaactggctggccgccgacagttcggacgcggcgatcaccggtaccaatccgcacgccatcgcctcgatcacgctcaccgattcgatgtcggcaatcgaacaatgcacgaacaaatcgcccgaacgcaacaaatcgggcatatcggcgtgcttgtggaatccgatatcggccttgcgcgccagcaaacgcccggcgcggaacttgagatactgcttgagcggcccagtaccggcgatcaccagctgaatatcgccggcgtggcgggacatcgacaccgccttgatcagcgtaatctgatctttctcgctggccagtcggccggaagcgacgacacggaacggcacgggagccgaggcatccggatcggccggcttcttcggcgaatacaccggtgaataaccattggaaatcacgtgcaacttggctttatacccgtgcgcgcgcaacaggctcgcggtcatttcggtgggcacatggatgtggtcaatgtgcttgtacagccagtgcttgaacagccagtacaggaagctggaaataccgggaatgcgacgtagagggccggccgaatacagcacgttctccggctgcaggtggaatccggcagtcacgggaatgcccatttggtgggcgactttagcggcacgacggccgaatttgaacggcatatagatatgcaccacatccacgccttgaaaggcggtgcggaacaacgtgtcgctgggttcggcgaattgcatgagctgcttggcggccacccacgagacgagcggcaccctattcacgcgcgccggatattcgggcgcccctataccgacaagcctcacatgatggccttgccgctccaattccgcagcccattgcaaggccgaattggaggtgccgttgccctgattgcccaccgtatcgaccacaagagcgatagtcagcggacgatcaatgctctcttcaatcccgttttcgcgcattgcctcatcctaaaccaccgcgctgcaatggcgtcggccgcgctgcctgaacgcgtatgaaatggtatgggctgccgcattttgcccaatattgaatcacgcgctccgcagcgcacgtcgccgaatccgagccccgcataggcgaaatcatcgcggcatggcagaatgtgggtatgactgaaaacgccgtgaacactgccgtgacttccgcctcctctcccgcaattcccgccgagacttccgccgttccccccacaactcgcacagccaaccgcccgctgggcacaccgctgggcaagcaccccacccgcgtgctgtttttgggcgctggcgagctgggcaaggaggtcacacttgaactcatgcgactgggcgcatgggtgtgtgctgctgactcctatgccggcgctccggcccagcaggtggcgcatgaataccgcgcgttggatatggcgaatgccgccgaattgcaggcattgttcgatgaaatcaagccggacatcatcgtgcccgaagtagaggccatcgccaccgatgtgctggccggtgctgcggccgcgggcgcccaggtggtgccgagcgccgaaatcgccgcgatttgcatggaccgcgagcgcctgcgcgtactggcccacgaagaattgggcttgccgactacaccgtatcgttttgccggctcgctggaagagctgcgcgccggagcttcggaagtcggctatccgtgcgtggtcaagccggtgatgagctcgtctggtcacggccagtcggtggtgcgttccgccgacgccatcgatgccgcttggaccgaagcgcaggagggccgccgcgccgccgatgagggcgatgtgtcgcgcgtgatcgttgaggcgcttgctccgctggagcgtgagctgacggtactgactgtttcttcgtccgccggcattgtgacgtgcgcgccgatcggccaacgtcaggagtccggcgattaccgcgagtcctggcagccggctaccgaacccgatggtgaggccgagcgggcgcgcgacatcgcacgtaccgccgttgaaggcttggtggccaaggctcaggcggccggcgaaaccggttggggcgtattcggcgtggaactgttcgtgctcaccgacggctcgattctgttcaacgaggtctccccccgtccgcacgataccggtatggtgacaatggcctcccagcgtctgagcgagttcgcgctgcacgcccgcgcgattctcggcctgccgatcacccccgagcatgtgtcgctcacgattccggccggctcggtggcggcaagccatgcgattgtggtggccggcgacggtgaggtcgagttcaccgatgtggccgctgctctggccgaacccggcacggacctgcgcatttttgccaagcccgaagtgcatggccaccgccgcatggccgtggcactggccgtcggcgagtccgaagccgacgcccgtgccaaggccggcctcgtggccgatgcgttgacgattaccgtggagtagtccacggcctgatcagctcagcatggcctcaatattattgccgtccgggtcgtggatgaacgatcatgacgaacctccttgtaccatttcgtcactcccattatcgtgtgtatatggccgaagagtcatgtttcgtctattgacgaacatctgagtattcacacgcgcttctgcagataccttcatgccggaaggctacacgaccggagacgagctgatcgtactggccaatgacggccgcctccgccatcccaacagcgtatggtcgttcgatgcagcgacgtatgatgcgctggccgcatcgtagcgtcatgccgagtgttgttgtagccctcgattggtacccttttaccgttagttcacccagaaattccactcctgaaaggtgagtcatggagaagctggaaaagctctacgagggcaaggccaagcaactgtacgcaaccgacgatcccgaggttctgtgggtcgaatacaagaacaccgccaccgctggcgatggtgaaaagaaggaagacttcaccggcaagggccgcctgaacaacctcatcaccaccatcatcttcgacctgctcaagaagcgcggcatcgacagccatctcatcaagcgagtgaacgacaccggccagctggtgcgcaaggtgaacatgttcccgttggagatcgtgctgcgcaacgtggccgccggccacttctgctcccgtctgggcgtggaggaaggactgccgctcaaggagccggtgcttgagtacttcctgaagaacgatgatctgcacgatccgttcgtcaacgacgatgacctggtggccctcgacgtatgcactcgcgaggatctcgccgagatcgccccgctggcccgcaagatcaacgaggccctgatcgagatcttcgccaagatcgacgtcaagctggtcgacttcaagatcgaaatgggccgcgccaccgacggcacgctgctgttggccgacgagatcaccccggattcctgccgtctgtgggaccagaaggaccactccggcaaggtcgagcaccttgacaaggacctgttccgccgtggtctcggcagcatcatcccggcctacgaagagatcgaggagcgcctcgccgaactcgccaagtccgaaggcatcgaagtcgccgagtaatgcattatctggctcccctctcgaggggagccaattgtctttaatttcaagaaaggatttccatggtttttcgcgtgtacgtggaaaagaagcccggctttgatgtcgaagcccagcagcttgcgggcgaactgcgcacgattctcggactgaacggcctcaaggccctgcgcatcgtgaaccgctatgacgtcgaaggcatctcccaggaactgttcgaccagaccgtgcccaccgtgttcagcgaaccccaggtggacaatgtggcctacgacctgcccgacttcgccggagccaaggtcttcgccaccgagttcctgcccggccagttcgaccagcgcgccgactccgccgccgaatgcatccagctcatctcccagggcgagcgcccgacggtccgctccgccaagctgtacgcgctggaaggtgacctgaccgacgccgacgtggacaccatcaagcgttacgtgatcaacccggtcgaggcccgcgaggccagcctggagaccaaggaaaccctgaagacccaggtgccggtgcccggcaaggtcgagaccatcgccggtttcaacgagatggacgccgaagccggccagaagttcatcgacgagcgcggtctggccatggacctggccgacctcgaattctgccagaagtacttcagcgaggagggccgcgaacccaccatcaccgagatcaaggtgatcgacacctactggtccgaccactgccgtcacaccacgttcggcactgagctggacgaagtgaccatcgatgacgccaccgtcaaggccgccttcgagcgttatctggcgatgcgccacgagctcggccgcgacaccaagcccgtctgcctcatggacatgggcaccatcggcgccaagtggctcaagaagaacggcgtcctgaccggcctcgacgagtccgaggaaatcaacgcctgcaccgtcaaggtcaaggttgacgtgaacggccacgacgaggactggctgttcctgttcaagaacgagacccacaaccaccccaccgaaatcgaaccgtttggtggcgcggccacctgcatcggcggctgcatccgcgatcctctgtccggccgctcctacgtgtatcaggcgatgcgcgtcaccggcgccgcggacccgaccgtgccggtctccgagacgctggaaggcaagctcccccagcgcaagctcgtgaccaccgccgcagccggctacagctcctacggcaaccagatcggtctggccaccggtcaggtcgacgagatctaccaccccggctacgtggccaagcgcatggaggtgggtgcggtcgtggccgccaccccggccgaccatgtgcgccgcgaaaccccggcccccggcgacaagattatcctgctgggcggccgcaccggccgtgacggcatcggtggcgccaccggttcgtccaaggcgcataacgtggaatcgctcgaactcgacggcgccgaggtgcagaagggtaacgctccggtggagcgcaagctgcagcgtctgttccgccgcggcgatgcctgccgtctgatcaagcgctgcaacgacttcggcgcgggtggcgtgtccgtggcggtcggcgagttggccgacggcctgttcgtggacctcaacaccgtgcccaaaaagtacgagggcctggacggcaccgagctggccatctccgaatcccaggagcgcatggccgtggacgtggccgccgaggacgtggacgagttcctggcctacgcccgcgaagagaacctcgaagccacggtgatcgccaccgtgaccgaggacccgcgcatggtgatgacctggaacggcgacaagatcgtgaatctgtcccgtgagttcctggcctccaacggcgcttccaagcaccagaccgtgcatgtcgaggcacagcagtcctacgagaccccgtggggcgagggcacgctggccgagcgcatgaacgagctggtcaccgacatcaacgtggcctccaacaaaggcctttcggagcgcttcgactccaccatcggcgcgggcaccgtgctcatgccgttcggcggcaagcgtcagctcaccccgaacatggccatggtcgccaagctgccggtgttcggcgagaccaccaccgcttcggcgatggcgtggggcttcaacccgtacatcatgtccaagaaccagttcaccggcgcctacctgtccgtggtcgagtcgctggccaagctggtcgcggccggcttcgagcatgagaaggcctacctgagcttccaggagtacttcgagaagctgcgcgacgagccggaacgctggggcaagccggcggccgccgtactcggcgcgctgatggcccaggtggacctgggcgccggcgccatcggcggcaaggactccatgtccggttcgttcgaggatctcgacgtgccgccgacgctgatctccttcgccgtggccgtgggcaacatgaagcgcgccacctcccctgaattcaaggacgccgatcaccgtatcgtacgcatcgcgccgcgctacctggccgacggtctgaccccggacaaggatgcgctgcttgaggtgttctccgtgatcgaggagctcaccgacttccacgatgccctggccgtctctacgccgggctatggcgccaccgccgaagccctgttcaagatgacgctcggcaaccgcatcggcgtgaccctgaacaacagcatcgccgtggacgacctgttcaccccggcatacggttcgttcatcgtcgagctggcggacgatgccaagcttccggccgtctccaatttggtcgagatcggcgaaatcggcaccaccacctccgagtacgtgttcaaggccgccggcgagacgctggacctggacgctgtgcaggaagcttgggagtccggcatcgaatccgtgttcccgtaccgttccaagggcgaggacaagggcgcgaccgtcgagaccatcgacttccacgcgccgaagaagaccgtgtacgtcggctcttccgtggccaagccgcatgtggtgatcccggtgttcccgggcaacaactgcgagtacgattccgccgccgccttcgagcgtgccggcgccgatgtgaccacactgatcgtcaacaacctgacgccggccgccgtcgccgaatccacgcaggcgttggtcgacgagatcaacaagagccagatcgtgatgatcccaggcggcttctccggcggcgacgagccggacggttccgccaagttcatcaccgcgttcttccgtgcgccggccgtcaccgaggccgtgcgtgacctgctgaagaaccgcgatggtctgatgctcggcatctgcaacggcttccaggcgctcgtcaagctgggtctggtgccgtacggcgacatcgtgccgatgaccgacgcctgcccgacgctgaccttcaacaccatcggccgccaccagagccgactggtccgcacgcgcgtggcctccgacctctccccgtggctgtccaagacttcggtcggcgacattcacaccgtggccatctcccacggcgagggccgcttcgtggcctccgacgaggtgctcgcccagctcagggccaacggccagatcgccacgcagtacgtggacgagaccggcacccccggcatggacctggatgtgaacccgaacggctcgctgctcgccatcgagggcatcaccagcccggacggccgcgtgtttggcaagatgggtcactcggagcgttccggcaacggcctgtacgtcaacgtgcccggcaacaagtaccagccgatcttcgaggccggcgtggaatacttcaccgcctgataatcggcgcgtatcgcgtctgatacggcacacagggaaggaactctcgggttccttcccttttttgttcatgccggtcatgggctaaggttggggtgttcgcactaccgaatccgccgctgaaaggacctgtcgtcatgccgatcaacgaggcattgttcgccgcgatgaaggccgccagctacatcaagcccaacgtgggcaagtcgtacaaattgcagcgcgtggcggaagagcttatcgccaagcaggcacccgacaatccgaaatgccgtgtcgaggacgccttcgcgcctatggcggatggatatgccgtaccattgcgagtgttcacgccgctggtcgcctatggagcgcccctgcccgaagccctggaggaatcttccgccaatggcacgcccgtggcctcggcaatatccgcgattctgcccgccgtattacccaaagtcctacccaaaatactcatcaaggaaagcacgtcgagcggcaacgccgacggtatttccggcaatgccaacacggaacttccctcagtcacgccgcgtggcacgatcctgtttttccacggtggcggttggaccacaggcggcatcaacctgtacacgcaggcttgcgcgcatatggccgtacgtctgcaacgccgtgtgatctcagtcgagtaccggctggctcctgaataccgcttccctactgctgttgaggattgctatgaggtagcccggcagctgtttgctggggaattgccgatttctggggtgggtggttctgttgatgttgatcacccccagtcggctgcgccgacagcccccgccggcgggggcgatatatctgcgacaatcccagcaccggatcccgacagcatcgtgctgtttggcgacagcgcgggcggcaatcttgcggccgccgtctcgctcatggcccgcgaccgcggcgagttcatgccgcgcacgcagatgctgctttacccggtagtcggcaacgattacaatcccgagaccagcccgttcgaatcggtgcggaccaacggcaccgactacatcctcaccgcacaggacatggccgactacatcgacatgtaccgttcgtccgtggccgatctgaccaatccgtatttcgcgccgctcaccgcgcacgacctgagcaatcagccgcgcacgctggtgttgtccgccgaatactgcccgctcagagacgaggacgaagcgtacgcccgtcgcctgcaattggtgaacgacaacgtctcctgttaccgaattcacgatggcatccacggctacctgctcaatacgtcggccgtgggactggtggccaccacctaccgaatcatcgagcatttcctcgacggcacaccgctggaaccagctcccggcaccggcaccaccgccaacgcaccggagggaggcgacgcgtggcaagacgtacttggtaccgactagacaacatcggcaagttctactcctcccaggctggccgctcctcgcagaccgtgttccgctattcggccgagctggcggacggcatcgatccggacatcctgcagcacgcgctcgaccatgccatcgcccagttcccgagcttcaacgtgcacctgctcaacggcatgttctggcattacctcgaacagtcagacggccggccgctggtggagccggaacatctgccgatatgctcgcgactgcattacgggcccaaaagcatgctgttccgcgtaagctatttccgcaatcgtgtcaatctcgaggtctcgcacatcatttcggacggtcgcggcgccatcaacctgttcaagtcgctgctgcacgcctacatcgccgagcgatacgacgtgccgggcgtgccttcggattacgacggttcggatagcgacaaagccgaaaacagcttcgacaaatactacgagaaagacaaggccggcgctgcgccaggcacgaagatctaccggctggccggccccatcgaccgggccgcgcctacgttcatggaataccacgtcagcgccagcaaggtgcttggtgcagcgcatcagtgcggagtgagtctcacctcctacctcatcgccgcgatactgtgcgcgattcgcgacgtcatgccctcgcgcgcccgcaatcgcgcgattcgcgtggatattccggtcgacttgcgcgccttcttcaggtcggagaccgtgcgcaacttctacggcatgacttacgtggcgtacacgccggccgaaatcgaagccgatgaggactccgcgaaaacttccgcaacaagcccagacgcagccggcgacggccagcagtccgccgcccgcaccgcgcacggcaacggtatgggtggattgctgaccgatgagccgttggccggcatcgcccgccatgtgcaggagcagctcggccatgccaccagtcgcgagcgcgtcgaatcgcatatgaaccgcatgattgcgctggaaaagaatccggtgctgcgtcttgcgccctcccctgccaaggactgggtgctggagctggcccggttcatcgccgaccgcgagaccacgaccaccgtctcgaaccttggccgagtcaccttggacgaacgactcgcgcgccatgtacgttcggtgagcttcctcaccacaccggccagcctgaatttcacggtctgctcgttcggcgacgacctgagcatcggcatctccaccatctaccatgatctgaacgtcatcaagaacctgtgtcggattctcgccgcgcagggcatcagcggccgtatgaacatcgctggcgtgcatgtggagaaaggagcgtcggcatgaagcattgcgatgcctgcaccgtcgatttcaccggcgatatggcccgttgcccgctctgccagaacgaattgcgcggcgaggcctcccccgccgcattccccgcgcagcagatctatctgcgtccgaggcgtttggcggtggaaatcatcacgtttgtaaccggcgcgattttgctgctgcatggcttcttcagctatctgttttcgtggccgataccgattgccagtgcatcggcggccgcgctgatcatcagcgtgctgttcatcaatagtgcgattctgcacgtgccgcggccgcttcgcctcatgtttcgatatttctatatcatgctggcgattgcgctggtctggtttgtggcgacgatgaatcatgtcgtcaccatgttcgtcataccgatcacgtgtctggtttcgctggtctttgacgtggtgctgcttatcgtgctgcgggccaaggccattgacgagtacgccaagtatctggcgttcgacatcgtcgctggtctgatgcctctgacgttcattccgctcggctgggctccgtgggatgtactggtgatggtcagcgggctggtctccctgctggtgctgctcggcctgctcgtcttcgcccgccgtcagctcttctcggaattcggcaaacagttctcggcctgattgcctcgtgcgctcaatcgcccgacttaggatggaaaccatgagcgaacatgtggagcatgggtttgggccggtgtgggatggcgagtcccgggttttgattttgggatcgatgccgagtccgaaatcccgagcggcggcgtacagccgaggcgagcatccgcgagagcggcagcaggtagaggaaggtcgcggcggccaggctgagtgtgggcgcgttgatggtggcaagcggcacggcaccggcgatcgaccaaggaatcagcggagcgatcaccacggcactgtcttccaaatcgatagcttgtgcggagcgttcggattcgtcgtcgccgtacagcccaccgcacaactggtgagtgagcatgatggtgagggtttggttgcaggcgagcgccgccgcgcaagtcgcggtaatcatggtggcaccacatgcgccgatgcgatgaccgagcatctcgatgacctgctgcagccgagcaagcatccgcgtctcggcaaaaatgccggcgtaggcggaggagatacagacagtggccatcacagtgagcatggagaggatgccgccgccgtccaggagtgcggccacctgcggattttgcgcatggtaaccgaaaataagcagccgcaacagttccgcccattccatgtgctgcacgcccacgcatatcgcgaccgaggcggcaatgctggcgagcataagcagccgaacgtccacatgcagcaacgccaacacgatgaccagtaatgctggaactagggtaagccaatgcaaatcgaaggccgatgagaacaatccgccgatatcggttatgctgcttgcgttggttgaaacagccgcgctagccgagccagccgagccagccgtagcagccgcactagccgcaccaaatccggaaccaccgctcgcacacagccactccgccaccgcagccgcaacgtatatcacacaactcagcacaaacggcaccgcaccagtgcgcagcatgcgggcaatagtattgaacaggttcgtacgcgtaagctgtttgaccagcaaggcactggtggaaaccggcgaacaacgatcgcccacatagacgcccgcaagaatcgcgccaccgagcatcaccgggttcgcctgcatcgacaatcccagcgacatgcagatggtgcccatagtcgccgcactggcgaacgacgacccgaccagcaccgacatcgccgagcacagtagaaacgacagcggaatcaccgtggcggcgtgaatcaccgcggtcgaatgggccacgatgaaggcgatggtcccgctggcccgccacagcgaggtcagcacaccgatgagcacgaaggccaccaccacggtccccgcggaccgtacgctgccggccgcacggctcgccatcgcgcgcagcgagcaccggcgaaccagcccataccccatgaacagcagcgcaccaacgaacagcgcgggaataatcgaccagccgagggcgacgctggcaaacagcaccgcacagaacagcaacatcgtgcccgcttccagcatgcgatcttctccctcttctggctacagcctcatctcagattccatctcatgacccgcagtcgcaaacatcaacgctattcgcacgagccatgactcaagataacaggagattctacgacgaacgtatggtactggttattgcgcaatcattatggctggatttagtcaccaccggaaccgcgaacagccagactaatattgccaacgattccgccatccccaacacgattccaaatgaacgcgccattgcttcaggcgatctatcttcgttggcacactgcccgtttttgctgggcaatccgcaggacatcgatggccgcattgccgatctgctgttccgccgtgccggttttgagccgaaagtcacagcccgttcggataacgtactgactctgctggaactgtgccattacggcatgggtgcctgcctatgcccggagcggttcctgccagcgctgcttgacggcgaacggttgcgtactttgcgcgtgctggattgcggcccggataccgcatatgccattcagttcggcgttccggccacatcgtatcggtggagcgtcattgatgatttcattcgttgcgcccgcgaagtcaccaccggcgtgtcgcaatagccgccaacttgcgttcaagtggggttgaactgtttcaataagaattgttagcgttcacggccggccatgaagagacgacggtgacgattgattatcaaggagcacacatgaagtatcgcagcgttggcaagtcgggactgaagatcagcgaggtcgcactgggcagctgggtcacggatctcaagggcacggcggctgaggacgtggccaaggagaccgtgaagctcgcctacgattccggcgtcaacttcttcgactgcgcggacgcctattctggcggcgcggccgaacgcttcctcggcaagacgctgaagcagtacccgcgtaaggaactggtcatttccagcaaggtctacttccccaccggcgaaggcgtgaacgaccgcggcctgtcccgcaagcacattttcgagagcatcgaccagacgctgaagaacatgcagaccgattatctggacatgtacttctgccaccgttttgacgagaccaccgaccttaccgagaccttgcgcgcgatgagcgacctggtcgcccaaggcaaggtgctgtactatggcgtttccgaggagtggggttcggctcgccttgaagaggcccagcgcatcatcgaccgctacaacctgtacccgatcaccgtggttcagccgcagtacaacctaaacgaccgttacatcgagcatgagatcatgggcacctgccgcaagctcggcatcggcatcaccacgttctccccgctcgcgcagggtctgctgaccggcaagtaccgcaagggccagccgctgccggccggctcgcgcgccacctggcagtccgaccaccagatcaacgatctgctgaccgatgagaacctcgacaaggtcgagcagctgcgcaaggtggccgacgagctcggcacgaacctgccggtgctttccatggcatggatcctgcagcacccggagatcagctgtgtgatcgccggcgcctccaagcccagccaactggagaacaacatgaaggccgcgggctttgtgattccggctgacgcgatggccgaaatcgacaagatcaccggcttccaccgcttcgaacgtcacgtaggctgacgaatctgagacttcctccaacgggagcgattgtcaagcgccgaaatcggtatcgccttgggcttcggcctgagcgatggcggtttcggcgttttttgctgtttgctcgatgacttggttgtagccggtcagggccgcgaacggcatgaactgcgcggcccgctggtggcgggacatgtgcggatgcttgcgcgactgatggtgtggcaggttgatgatgtcgtcgtatgcatgggtctcttgcagggtcatgcgcgatggcctccgatctgacggttgcggtcctgaccggtggcgccgtcttccatatccatggctttgatgacggcgttgcggccgaatttacgtttcacatccagcagcgcacgctggatatcatgctctccatctttttcgctggtggaatcggatccatacgattgggccccgtcatcaccgaacaagtcgagctgttcatagcgtttgccggcggccagctcctccggagtggccacatcatcggcgatgacggtcaaccgcctcacaagcaagcgtgaatccacaatgcgctcgtacaacatcgtcatggcctcacgaatacgtgccgacgacgaggtgaaatcacccaaaccaatcgacccgaccgcgctcttgggcaccttgcgcccaaatcggtcgatggtcaccggcccttgatagcttttcgctgctcgctcagcggcacgtttcatcgcataatcagcgcacgaatcgagctttgacgaatcaagactgccgatgtcatagccgacggcgagcgtcagtcggttcgtcagcacgcttttatcgaccagatcgagggccagcgcatcggccatctccttggtgatcagccgggccgtggcatagtcggcggggccggtgagcacctgcccactgctaatgctgtgcacacctggctcataggatcggatatccgcgatttcgcacggctcccagccccacgcatggtcgatgagcagttcggcattgacaccgaacatgcgatacagcaggtcttcgttgtagtaatccgaagcacgacccaccgagcatcgggcgatatcgcccatggtcatcagtccggcatgctcgagcttcttggcatagccgcgcccaacccgccaaaaatcggtgagcggacgatgatcccaaagcagccgacgatatgacatttcattcagttcggccacgcgcacgccgtccttgtcggcgggcatgtgcttggcgacgatatccatggcgactttggccagatacatgttggagccgatgccggcagtggcggtgatgccggttttggtgaggatttcgcgcacgatggttcgcgccatcgcatgcggccccatacccagcgagcgcagatatggcgtggcgtcgatgaacacctcgtcaatcgagtagacatggatgtgctcgggtgcggcgtatttgaggtagatgccatatatttgcccgctgatttccagatagtgcgccatgcgcggcttggcgatgaccatcgaggctttgagccccggcgagcgttccaggtcgcacgcatcgcaggactccccgattaatcggccgccgggagcatggaccgcgcgctcgatgttgactccattcaggcgctgttttacctcaaacagccgcgcacggccaggaatgccatagttcttcagcgagggtgagaccgccaaacatattgtcttatcggtgcgggtttcatcggccaccaccagatgcgtggtcaacgggtcgagcccacgagccacgcactccaccgaggcatagaaggacttgagatcaatggcaatataggtatgctcgcgttgcgtcgataccgttccgctgcccatcgccatcacctccttaccaccgctggcccgaccagcatatcaacacagtcgaacatttgttcgatgcaacatgcctgttcgaagctgccgaagtcgacgcacgcaacgcgcccaagcacgctcttcacccacgccacacgcgcagcggcggagcagcggcatgcatgcgtaccatggggaatatgaagaaaagcattacagcagacagcgattttgcagcgtgggcggcagcccgatcccagaagacgaatcgatcactggcaggagcccgactcgcgattccggagccacagaagcatgccgaaatcaagtctcaggcccagcaatggggcatgaccgtcgaagatgccacgatgaccgacgagcacaacgaggaattcctatgcgacggcacacaaagcatcgattccatcaccgatatgcgcaaggcaagcggactggaggcaatggagtacgcggaacagcacatgccggtattacgtgacaccatggatagcctcaccactcgcgtcgatttctcaggcattcgtattgccgtctgtctgatactggagccaaagaccgcgattctgctgcgcaagcttaaggccgccggcgcaatcgtcggcgtatattgcggcccggattccacggatccccgagtggcggaacagctgcgccgggaaggaatcacggtcgaatccagccgagactggaccgcggaacaggcgcacgaggcggccctgcacctgctggacgagatacagccggacatcatcatcgacgatggtgccagcttcgcccgtctcgcctcgctcgaacgccccgaactcacggcgaacctcattggagtggccgaggaaacgaccagcggcgtacgcgcgttccagcagatgcaggaagcgggagccctcacctacccggtcgtagccgttaacgacagtgtgctgaaaaccggattcgacaacgcccacggcactggggagacatgcgtgaccaccatgcagcgcattctcggcgagcatgcattcgacggtaagaacgtcaccgtcatcggctacggcccggtcggccaaggcttcgcacggcgcattcgcgcgcttggcgccgaagtcaccatctgcgatatcgatccagtggcttcactcaaagcggtgttcgacggcttcgccgcacaagacattgacgaggcactcccttgcgcggatatggtggtgtccgccactggcgtgagacatacggtcacacttgagcacatgcgcgcaatgcacgagggcgcggcgctcgcagtgatcggcggcatcgccaacgaaatcgccttggacgaggtaagcgacttcaccccacaggtcaacagggacaccgtgcaactcaatgttcccgacggaccaacgctcacgctaatcgccgacggcgatggcgtgaactacacggtgggaggcggcaatccaatcgagatcatggatctgagcttcgccgtacaggccagcgccgtcgcatatcttctggaacatcgaggcacactggatcacacgcttatcagacttgacgcagcgaccgaccagcgcatcgccgccagcgcgctcaaggcgcgcggataccgagccagccatgccgtggaggacaacggctacaattggcgactgaccagattcgcggaaaacgaccgagagaacgccgaccgatagccatagacacggcaccgaacacaacgcagcgaggagaatatgaccgacaacacctggccgaccgtcgataccgagcttatcgatgatgtgacactgtattccgccaaactcatcatccccgtgacgggccccgtcatcatcgatggcgcagttgccatacatggcgaccgcgtggttcatgtaggtaaacgccgctgggtgctgaaggcgctgaagcaggaaatgacggctcacggcaccatccatgaacggcattgggatggggtgctcacccccggattgatcaacgcgcacactcatctgcagtacagcggcatggtgcaggtcgggcaaggcacctacgatcggttccgcgcctgggaactggcattcaacgaggtgtacgccgaggcgcagaagacccagccatggaagcagtgggccgaggacggcgctcgccagatggtcgaatcgggaacgacggccgccgcagacatcgtcaccgatttggacgccgccggcgcgctggcttcgcagggcatgcacggcatcgcttattgggaggtaatgggctggcacaacgccgaatggatggaaaagggccgcactgagctcatccggcagttgcgccggatgaacgaggagcagctgccaaacctcggcatcagcccgcatgctccgtatacgctggagtccgaaccgttcgttgatcttccagacattgctcgtcagctgaacatgcgactgcatatccatctggcggagaccccgctcgaggccggcacttatccgccggtgctcaccacttattcggcggccgactggagtgaccacgattgggaaagctaccggcagctcaaggaagtgggcaaaggcgcctccgccatccagttcgtcgatcagcttggctcgcttggaccggatgtgcacattgcacacggcgtgtgggccaatggcgaggatcggcgtattctacgtcagcgcggcgtgggcgtggccttgtgcccccgatcgaatcgcattaccaacaccggcaaagatgcaccggtgcgcgaatacctcgaggaaggcaatctggtaagcgtgggcaccgattcgctctccagcacgccgaccctcgatctgcttgatgatgtgtcgatgctttacgacctggcccgcgaacaaggctatgccagcgacgatctgacacatcgcctgattcgtatgatgacgctgggcggcgccgcctccatgggcatgcacgtgggccgcaaccgcattggacaaatcaacgcggcgctcgaggccggcacttatccgccggtgctcaccacttattcggcggccgatcggggcaaccatgaacaccgggtgatcctcagacggcttgatgtagccgtagtggatgttgaaaccgtgggcgaaggccaaggcagcgcccggcttcagattcggctcaatgtccttcttgtagacggctgcctggtactggtcaggcagaagaatcatcacaacgtcagcctcggcaacggcctcgccaaccggcttgacctcaaggccctgctccttggcgaactccacggacttggaggtaggacgcaggccgacgaccacgtcgacaccggagtcacgcaggttcagcgcgtgggcgtgaccctgagaaccgtagcccaggatagccaccttcttgccatcgaacacggacagatcggcgtccttctcgtaccagatagttgctgccatttttggcgctccttttatttatttgtttatttatggggttgaatttttcttgcgttctgcggggtttcgctgagcgatattctgttgtggctttccttgtgggcttttccgatatgcaggtttagtcccgtcgcatcggaaaagccctgtaggggttcacttagtggaattaggggttttcacgttgtgaacatcgtcacttggtaaagtcaacgtccttagtctccttgcaggtgagcacggagacgaggcagcacacggccatcacggcaaggtagaggcccacggagtggacgccccagtgggagctcagccaagtggcgatggtcggcacgaaagccgcgccgacgatggcggccaggttgtagccgatgccggagccggagtaacgcacgttggcgtcgaacagctcaggcaggaaggcgccgatcgggccgaaggcgatgcccatcagggcaaagccgacgcacaggaacaccatgttggcgaagaagttcttctggccgaccagaccaccgtccagcaggaacgggaagagtacggcgaacaccacaagtgcgcaggaggagaaggtcagcacgcgacggcggccgatcttgtccgcgtacaggcaggacagcacgatgaacagggcgaacacgcagatggagatcatgagcatgagcaggtattcctggttggtgaagccaaggttgccgccgccttcgccctgctccttggtgccccaagcgagggaccaggtggcgagcgtgtagaacagcgtgtaggtcacagccacaaggaaggtggcctgcagcacctgacgccaagacttgcggaagacctcggtcagcggggacttgacaaccttcttctgctcctgagccatacggaagatcggggtctcctccatgtgaacgcggaccacgagaccgacgatcaccaggatggcggacagcaggaacggcacacgccagccccaagccagcatcgcgtcctgattgttgaaggattcgagcacgaagtaggtgccgttggacaggaagaagccgatcggggcgccgagctccgggaaggagccgtacagtgcgcgcttgtcttcaggcgcgttctcggtggcgaccagtgccgcgccggaccattcgccgcccaggccgatgccctggatgaaacgcagcaggcagaggatggcgactgcaccaacgccgacctgatcgtaggtgggcaggcagccaatcaggaaggtgccgacacccatggtcatcaggctgacgaccagcgtggtcttgcggcccatgcgatcgccgaagtggccgaagatcagcgagcccagcgggcgggcgatgaaggcgacggcgaaggtcagcaagctcatcagcagtgcgacggtggggttgtccttcgcagagaagaagatgtgcggaaagtagtttgccgcggcggtgccgtaggcgtagaagtcatagaattcgatggcggtaccgaccatcgacgcggcgatcacggtcttgaccgaatcgcgtaccaaggtagcggctttacctgccgcctgccctaagccagtctcttcgactgctgcagtcattgttactcctgttttgctctcgttcactctcatcggcgggcgattatttcgccccacagggaggttgttgttctgtcgctgtgttgttgccgtgtactgtccgctaccgtttccgtctgcgggattctgccgtaagccttgtgagcgcaacaaaaaagccccgcatcatgcagggccgtgccgattgtgtcagcttgattggccctgccttcgttgacggggcttcaagcatcagtgccgaattagtccgccagcgaagacgggctaataattcgtgcggatacaaacgcagaagcattgaatccagtcatcgcgtggcctcctttcggtatttcctcaggccgttcgacctgaactggaatgtaaacataggtttgtatgtcttgccaatccagcaagggttcacattgtggacattgtgacgtaggagtcatgtgagatgggtgactgtgcgcggctgcgccttggctcccctcagagagaggggagccaagataggagtcaccgggtggtttcgccggggatgagggttacggggatgacttcttcgggagtgggttgggtgtcaacgtccgaagcgctatcgttcttggacggagaggcggggccaccgtcggcggcgatctgtgagtccatgcggacggcgagcgcggcggcgatggccgggaagtcctgtcgaatcgcggtcaggcgtttgccggcggtttcggccatgagagtgccgtcataggcgatgacttgcagatcagcaggcacctcgataccccggcgcgaggcttcctgcaatgccacggatgccaccacatcggagccgacgatggcgtcgacatcgggataccgctcgaaaatggcgcatgcggtggctgcgtgggcggcgatgtcggccacggtgccggcttcgacataatcgcaggcaatgccggcctcagccagcagacgctcaacggtgagatggtagcgaatcgtggggaaagtggtgccttccgcgaactgggaacgcgggccaccaacgagcaccacgtggcgcgcgccggaatcgatgagctggcgcgcaatcagacggccgccctgttcatgatcagaccggacgaccggcacaccctcaccgagcgtgcggtcgaaagcgacaattggccgatggatggaggtccagtagtcggccggatgctcggtgtgggccgccatgatgatgccgtccatcatgtgccgctggagcatgtcgatgtactcgctctcgcccttgtctgtatcggcggtggagcagagcagggttttgaggtcgcgcgcggcgaactcgcgctgcagatgcgcggtgagtgtggagaagaacgggtgggcgatggtcggcatgatcacgccgatggtgttggtgcggtttcggtagaggttgcgggccagctcgttgggaatgtagttgagctggcgcatcgcggactcgactttggcacgcatatcggccgagacgtagccggtgttgttgaccaccaacgaaacggtgcttaaggacacccctgccgctttggctacgtcgcgcatgccgaccatggttttgctcccctgcgagtactggactggatcactgctgaccagtgtactcgaaccggtttattattcggcagatttggtggtgagggtgacgattccggccagcagcaccatgacgatggcggacgggaagagcaggtaatagccgaagctatgctcgaaggcgttcaccagtagcgcgccgatgatggcggcgagcgccagaccggccgagttggcgagcgcataaatgccgaggtcgtggccggctcggcgcgggtcgggcaaagagtccatcaccagttcaagtccgagcgaatcatagacgccaaaggcgaatccggaaatcaacgcaaacagcaacatgccgttttcacgggcagtgccggtggaccagacgccaaggccccatgcgagcgccaaaccagcggcatacagcaggcaggcaccggccaccacacgggccacgggaatgttcttttcctcgattcgctcggaaatcggcccggcggcccaggaggcgagcgcggcaccgatcaatgtggccacagccataccggcaatgaggaatccggccggaatggtcagcggcgcggacgtaagtaccacggccttgccataaacccagaaacgtacgagataccacagaaacacaccggtcagcccaacaccggccatcatgcacgtacgggcggcgaacatccgggagaactcgggagcgtgggccggcgggcgcaattggtcaagtacctgactgcggtcaaaaagctggttcggctgctcagtgctagaaggctccttgggcagaatcaatacggtggcaataccggacactgcaaatagcacggcggtgtaactaaacggcgtaaacgaattgaacatcacaccaagcgcacccatgcacacgccaagcgcttggccgagcatcacaccgatgccatgccagcgttcgatgcgagggcggaacttgtcgggcacccgttcgctgatggcgctggtcaacggcacggaaagcatcgcataggcgaactgtaggaacacccagaaaatacaaagcacaatgatgccgatattctgccccagaatcagcgtgatcagcgcgcacagcagacctccgccaaccatccacggggtacgacggcccaatggcgtgcgtgtgcggtcggacagggcggagaccagggacatcgagaacatggaggccacgacgccgacaatcaccagcaccgccagcggcatcgccaattcggtggcgacgggcaacgggcggccagtggccggattgatggcgatatgaccggcaacagcagtgtcatagccgaatgtacgcgcaatcgcgttgggcatggcaatggtgttcaacgccacccaaggtgcgccgaccagaattgaagcagcgaagaaaccccagttgagtcgggagacctgacctgcggtagggcgttggccattgacggcgaccatgggatcgcgcatgtcgaggtaggcggacgacatatccggcgcgggagtgtccacactggcggctgcagcagcggctgccgaagaaccggcggaagccaatcgcacagcctgggcctcaggctggtccgcagaggcttcgggcgggcggcggcgattcttgatggccagtctggccacggcggctttgtcttcgggacttaggaccttgtccaaatccgggcgatcatcaatacccggacgcacatacggttccaacatgatgctgctctttctctgttctgctgctcgtctcgtcgattccggcgggatgcttgggccgcgcccgcaggagcacgaccttcaaccccgcatacgcaaaaccgcccgagcgcactggcttcagtgcactgcgggcggtttgctctccatgaacccagcttacgccgggcgcactacttggagcgcgcacagcggagtggcgtttatgggccaacggttagtcgatatcggcaatcggcgggttggcgagcagatcgtgggtttcgtggtcgccggcggcatcgctccaggcaaggctggcgaccggggtggtattgtctgtgccgaggccgcgtccgggctcgaaggtgagggcggccgtggacgcgccgtcggcggcggtccagcggaaggtgatggacgtgtcgccatcgacctcgtagctgaactcgccgtcgaatgcagacagctcgttgcggaacttggccagggcgttcagggccttgaccaccgggcgttcgaggttttcatcgatttcggcggtggagtagtagtggcggttgatgtcgcggccgttgttggtgcggcgcagcagttccatgtcgttgcggccggcgagcgcgcccacgtagtagacctgcggcacgcccggcaggaagaactgcacggcgcgggcggccaagtagtgctggtcgttgcagccgagggccgagtagtacgtggagttgacctggtagaggtcgaggttggacgcggcggcaccggtggcggcctgggattcgccgtgggtgttggcatggatggtgttgaccaggttgtcgacgtcctcgtcgggcacgaggcccttgagggagcggtcgagctggtcggagccgatgtcgatcacgccgatgccatcgtgcgtatcgagcacggtgacggcgttgttcgggcggatctcggtccagtgggccacgggttcgacgtgaccggtgaacagcgagtgcagaagcagcggcggcagggcgaaatcgtagacgcggtccaccttggaggcgatctccacctgcttcttgtaatagctgtgaacctcgatgaggatttcaaggccgcgcttgacgccctcctcgcgcagacgggagatgagcttaaaggtcttgggggtcatgaagcagctggtgccggcttccttggcgccgtagcccacggcgtcgagacggatgtagcgcacgtggctggcggccatctgatcgaagatggacatcaggtattcccagcccttggcggaatcagtgtcgatgtccacctgctgcggagtgaagctgacccataccaaacgggtcttgccgccgaggttgtagtgggtgaacggcaggcccgggcgcgggcggtagatgccggccaggtcttcttcggtagcgccgttcgggaagacggagctcatggtcaggaacatcgggtagtactcggagttctcgccgttcttcagcacgtcctggaattgggcggattcccagctcatgtggttgacgatggcgtcgaccatgatgtcgtgggttgtggagagttcggcgacgtcatcccacgagccgaggcgcgggtcgaccttggtgtggtcgatcgggtcgaagccggcgtccgcgccgtcaaacggggtgaagaacggcaggatatgaacgccgtcatacacgccgttgaagcgggtgcgcaggatgtcggtcatcgagctaagagtgccatcgccgagacgatcggcgtatgtgatgagttgcactttgtttttcatgggacctcccttggctcatgggcgcgggtgcaatttgcgtgcgcatctgcctgtttgttgtttacgtatttgcatactcacgtatgtatcgaaccggttcgatattacctcgaaagggacgtcaatgtccagtcgcgcagtgaaatgcgcgtgtcgaaccgattagatgcggtgttctatgcagcttagcctgtccgactccaatgtgtccgattgataacgcccggtttgttgcgcattttggttgaggcttgagttgagagacatggtccgtcgtccgggtacgatttcagtcgccaaaccaaatcaacctatttaggaaggcgacggaaccatgccgaatcagattctacaggtcgacgagaacatgctcgagacgaagctggaccggttggtgtcggagaaggtcgaacagctgttgaacgcgatgctggacgcggaggccgacgagatcacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgtggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgattaagccgggtttgttgttaagccggggaacggttcggggtcttggtggctggccgtgtcccatgtcggggcaaccatgaacaccgggtgatcctcagacggcttgatgtagccgtagtgaatgttgaagccgtgggcgaacgcaacagcagcacccggcttgatgttgggctcgatgtcgttggcccagatggtgcgctggtactggtcgggggccaggatcatgatcacgtcggcctcggcggaagcctcggccacggacttgacctcgaggccctgctccttggcgaagtcgaccgacttggaggtcggacgcaggccgacgaccacgtcgacaccggaatcgcgaaggttcagcgcgtgggcgtggccctgggagccgtagccgatgattgcgactttcttgccttcgaggacggaaagatcgccgtcgttctcataccagatttgtgctgccattattggcactccttttcagtagtggggtgtggcgccgctgggcgccggggtatctacggtgtgcagataagtcctgtgttgcgaggattgtgtccttcaaaccgaaatcaatcctaccgagaacgccgtcgcagccccgctggagtccacaacgtgagctaggtcactattggagtatggacagccgtgtgcagagaacgattctcgataacaactctgcacccttttgaacagaatcgcacaatcccacatatggggaaaggctgagatatcaacgatcttgcatattcggtgttcgtttgcctgcaagaaatcagcgcatagttgttattgagaatgattcgctgcgcgcaacaacacaaaaccgccgctcccgtatgggcgggaacggcggtttgctagcttaaatccccttcaggggcggcaatcactgaacctgggtacgagcgatcttgccgttgaaggactcggcctcgtccttgtccttggcctcggcgttgttccaggagaacatggcgcgcagcttcgggccgacggtctcgagatgcgggtgagagtactcttcctgcagcttcttgaacttcggggcgccagcagcctgatcatccatgaactccttggcgaaggagccgtcctgaatgcgcttgagctggtactgcatgcgcttcttggtctcctcggtgatgaccgtggaggtgtagtcgccgtactgagcggtgtcggagcaggaccaacgagccttgttcagaccaccctcgttagcgaggtcgacgagcatcttcagctcgtggaacacctcgaagtaggcgatttccggctggtagccagcctcggtcagcacgtcgaagccgaggtcgcacaggtggttgatgccgcccatgaggacgtcctgctcaccgaacagatcggtctcggtctcctcggtgaaggtggtcttgatggcgcctgcacgcagagcgcccagagccttggcgtaagccaggcacagcggccaagtcttgccgtccgggtcctgctcaacagcaacgacgaccgggacaccacggccagcggcgtactcacgacgaacgatgtggcccgggcccttcggggcaaccatgaacaccgggtgatcctcagacggcttgatgtcctgaccctccttgcggtaggtcaggtgttgcaacgatcactagaacccgccataatcgtcaaacgctagggggggggacaccgcatggtgcgaggtttgccgcatggcggaggtgccatcgggtggagtatttggcaccccttggcaggtatttggcacattggcccccgcaaaaagcaaatggcccttggaattattccaagggccatttgcggctaatagcaccggagcattactcctcgaaaattaatctacgcgtgcggagaccgccgttcgaagccgaagacgcactgaagtacgtcgagtgctgaggaaagacggtatacgctccgtagattagttttcctcggcgtccgggtcgtagtcgacgccagtctcggcgcgctgctcgtcggaaatcggggccggagcaccggtcagcgggtcgcggccgccgccggccttcgggaaggcgatgacgtcgcggatggagtcggcaccggccaggatggacacggtgcggtcccaaccgagggccagacccgcgtgaggcggagcgccgtacttgaatgcctcaagcaggaagccgaacttctcgtcggcctcttccttggtgatgcccagcacatcgagcacacgggcttggatgtcgtcgcggtggatacgtacggaaccgccgcccatctcctcaccgttgcagacgatgtcgtaggaatcggacatggcgtgctcgggatccttgtcgaacttgtcgatccaatccttggagggcatggtgaacgggtggtgcatggaggtccacttggagtggccgacagccacatcgtcatcatccggatcgtcggtgggcttgaacagcgggaagtccacgacccaggtgaaagcgaacttcttcggatccagcaggccttcgcgggaggcgagttccacacgcacggcacccagcagcagctgggcggactcgcgggaaccggcggcgaagaacacggcgtcgccttcctcggcaccgacggcctcgcgcaggccggcgcgctcctcatcggacaggttcttggcgacggggcccttgagctcgccgttctcgccgaagaccacgtaggcaaggcccttggctccacgctgacgtgcccaatcctgccaagcgtcgaactgacgacgcggcgtggcggcaccgcccttgaagaccacggcacccacgtacggggcctggaacacgcggaacggcgtgttcttgaagtattcggtcagttccaccagcgggttgccgaagcgcaggtccggcttgtcggagccgtacttgtccatcgcatccttccaggtgatgcgcggcagcggcagctggacttcatagccggcggacttccagatggcggcgatgaccttctcggtcatggccatcacatcttcctgatccacataggccatttccatatcgagctgggtgaactcgggctgacggtcggcgcggaagtcctcgtcacggtagcagcgggcaagctggtagtagcgctcgacgccggagaccatgagcagctgcttgagcaactgcggggactgcggcagggcgtaccaggaaccgggcaccagacgggccggcaccacgaagtcgcgggcgccttccggggtggacttgatgaaggtcggggtctcgacctcggtgaagtccatgtcttccagcgcgtggcgggcggccttagccatgtcggaacgcagcttcagattgtgctgcatggacgggcggcgcaggtcgaggtaacggtacttcagacgcacgtcctcgccaggcagcttgttctcggactcattctcgagagcggtggaaacctggaacggcagggcgtcggacttggcgaggatttcgatagtctcggccacaacctcgatcttgccggtggccagatgggtgttctcgttgccatccgggcgcaggcgcacttcgccggtaatctgaatcacgaattcgctgcgcagcgggcgggccatatcctcgtcgtaaatgacgacctgcacgaggccggtcgaatcacgaaggtcgatgaaggccacgccaccgtgatcacggcgtcggtcaacccaaccggcgagggtgaccttctggccgaccagggcctcggtcacttcagtggcatgatgtgttctgtaagccgtctggctcattgtcttgtttctcctcgatttttcgcgcgaatacgtcagatttcgacggtttgctgggcaaccacagtatccggctcccacgacgtgcaatcggcggcaacctgctcgcccgtgacgatgttcttgacctcgtcgccagcgggctctgcgccttccacaccttcggcagcggtggccgggaaccacacgtacggaatgccgagtttgtccgcgtacttgatctgcttgccgagcttggccgcggtgggtgccacgtcagtagcgatgccgcgcgcacgcagttggttcgcaatacgattggcggccgggcggtcctcttcattccacacagcgaccagcacggcggccgggctgacacggttggcgtgagcgccggcggtgtgcagcatgtagctgaccagtcggctcaggccgatggacaggcccacgcccgggtacttgcggttgccctgggaggcgagattgtcgtaacggccaccggagcagatggagccgagtgatgcggcaccgtcgaggaaggtctcgtagacggaaccggtgtagtagtcgagaccgcgggcgatcttcaggtcggcgatgacggaaccggggcggatggcggcggcttcgtcgacgatcatggccagggtatcgagtccctgacgagccagcgtgtaggcctcggaatccttgacgatgccgtgagcctcgcacagcgcatcgaacttagcggcaagctcggcaccgtcggaggcggtgagctcggccaattcgaggcaggcgcgcgcctgtgcctcggtggcgccgcaggtctcggtgagcagtcgggccacctcatcggcaccgatcttgtcgagcttgtcgatctcgcgcagcacgccttcgacgtccgtcaggccaaggccacggtagaacccctcagacaacttgcgattattggcgtgcacggtggccttggggaggccatacgcgcgcagctcttccagtgcggagaccatgaccagcggcagttccacttcatagtggtcgggcaggtcgccggcgccgatcacgtcgatgtcggcctgcacgaactcgcggaagcggccttcctgcggacgctcgccacgccacaccttctgaatctgccagcgcttgaacgggaacgccaacgcacccgagtgctcgaccacataccggctcagcggcacggtcagatcgaaatgcaggcccaaacgctcttcaatcggagtgtcggattcatgaccgacctcctgcaaacggctcagcaggtaaatctccttgctggtctcgccttttttcagcaaagaagcgccggtttccaccgctcgcgtctcaatgccgatgaagccgttgagctcaaaaaccttacgaagcgtatcgataacacgctgctccacaacacgttcggaggggagccactccgggaatcctgatattgatgcacctttagccacgaaatcaatataataggtgagggttgcgtcaaaacttcctggttcgcccgggatgggagacgctcccgcttatgcattctacgctttaaggagctggccatggccgacgaaactgtcaccgaacccgtaaacaccgctgcgcccgaagagcaggcaacgacacccgcacccgaggccagcgcggccacgccggcgccgactccgtcccccgcttccatgccgaaaccgcacgcgccctcccccgccgccttcgccaagaagactccggcggccaagccgcgcgctgccgccccggccgccgccaccgccgcctattccgaggctgatgtcaaggccgccgaggccttcggccgcgtggatgacaacggcaccgtcttcgtcaaggatggcgacgccgagcgcgaggtaggccagttcccggatgtctccaaggaagaggcgttggcactgtacgcccgtcgtttcctggatctcaaggccaagctcgatctgctggccacccgcctggcttccccgaacatcaaggcccgtgaaatcgacgaatccgtgaagctcttgggtgaagaaacctccgagccagccgtcgtgggcgatcttgccgcactcaagacccagtacgaggagctgaaggctgccggcgaggccaagaagaccgaaatcgccgaggcacgcaaggccgcccaggccaaggccgttgccgagcgcaccgccattgtcgagaaggctgaagcactggccgcttctctgggcgacaacaccaactggcgctccaccgccgacaagttccgtaacctgttcgacgagtggcagaaccaccagcgcaccaccgtgcgcatcgacaagccggaggccgaggcgctgtggaagcgcttctccgtcgcccgtaccaccttcaaccaggctcgccgcaagtgggctcaggctcgcgacaacgagcgtacagccgccaaggaagccaaggaagcgattatcgccgaggccaatgagctcaaggattccaccgcttggggtgagacttcccgcaagttcaacgatctgatggaccgttggaagaaggccggccgcgctggccgtaacgaggacgacgagctgtgggccaagttccgcgaagccgccgacaccttcttcaacgctcgtcaggccgatcgcgatcagatcaactcctccgagaaggagaatctggctgccaaggaggctctgctggtcaaggccgaggctctggtgccggtgaagaccgacgccgaggccaagaaggcccgccaggagctggccaagattcaggaagagtgggatcagatcggttacgtgccgcgtgacgatatgcgccgcatcgagaaccgtctcgacgccgttgacaagcagatcaaggccatcgaggatgccgcttggaagcagaccgatccggaggccgacgcccgcaagtccagcttcgaagagcagcttcatgctcagctcgccgtgcttgacgagaagatcgccgctgagtccgacccgaagaagaaggccaagctcgaggccgagaaggccaccaaggagcagtggctgaacgccatcaagtaagacttccgcttatgcccccgctggcgggggctgtccaacatagtcggactgggagtggttccatacaacggccacccccagtcggcaaaccggcagccccccccgccagcgggggcaaatttgaccgcatgtaccggccaggagctctgatcttcctgctgggattgttcatcatacaatttgtcttcggcgtcgctgccgtgtatcggggaaagtaacctggtatatcctgcgataaacgcattggcagacacttgctgcctatctgtaaacacaccctagataaggcttgcggccgttggtcgagcacagtagtagtgtggtctgctgtgtcaacaggaggagtatgaccaatgcggctgatcgagacatggctggcggatccagaacgtgcgtttgacttgttcgcgaaattcccggcggaggagacgggattcgagaacccagcggccggcatgaatcgtgaacggttcgccgcatatgtgcgagggttgcgtgatgagtcgcttggcgtcggcctgccggacggctgggtgccagccaccaaatacattctcgtcaacgatgagggcgactatgtgggcatcttcaacctgcgtcaccggctcaccgacttcctgcgcaacggtccgggccacatcggctacggtgtcgcccgcgaataccgcggtcacggctacgcgaccgccgggctcaagctcacgcttgccaaggcccgcgagctcggcatcaaggaggcttacctgagtgtccacaaaaccaatccggcaagtcttgcggtgcagcagcattgcggcgcacgtatcgaccatgaggacaagacggaatactacacacgcatcgccacctgcacggagagcgatggcctctatgcgcgaggcgattgacggcgcctcttgcgtgtaaatggccgattatcaatcggttttaatcgatttcgcctcggtcgataaagtcgccgtcgaggaaccaataatcgtgcggatttccgcgtaacgccatgaacggcgtgagttccacgccctgtgtctcagatctgctcagcagataggctcggataatccacggatactccagcacgcccgacttgagggtgatgatttgctccactctgctgccgctgacgccaaaatccctgccgccgttcggcggtcagacccagccggctcatgttctcctgaaattcgcggatagtcgccgcgcgttgctcactgttcaaagacatggcttcatggtagcgccggacgcgtgtgggaggtcgggctgctcactggaatacgccgtcagagtagttgatcatttcgagttccgggcccatgtcttcggtttgagtcaggccggtctcatggaagccgatgtgacggtagaaaccttgggcgttggtgttgaatccggcgacccacaaggcgagccgatcgttgccgatggcgcgttggcccgcctcaaccaaagcacggccaacaccatgacgatggcaagattccaacacatatagcgaagccagttccgcagcctcggaccgtttgattggcgaacgcggcgtttgcagaagctcagcaaaaccaatcacgtggttgttctccaaagcgaccaatacgacctgattggggtctttggcgtggctgcgcgtcactttgagcgcgaattcgggagtgatcgcatccacgatttcctgcggaatatgcccctgattgagttcgcgccacgtgcacgactgaacttgggcctttttctcaaaccatggcggctcaatcgaaacaatacgaatcgtcatgccgcccatagtaggccggttcgtgagtacagtgtcacttgttgtcatgtgattgcttggcatcaggttgtattgaccgtaatggaggccactggatcagcgccggaaactcatggaattcgggctattatgatgggagtaagaaaagcacagcacaattgaacataaagacgatctggagcattgcatgagcgtcaatacggcatttgaaaccagtgatttgcccaaagcggagtttatgtttcctgggcctgaacgcgatcgcttggtgaagctcattctggacggcgtaaaaaccgccaccgctgcgctgatgattgaatatgaggaagaggtcgaaccgctgccgtgcgttggcgcgcattcggtgttggtggattccgatgaacgacccgtagccgtactcgtcaccactgcggttgacgtgattccgctcggaaaagtcactgaccggtacgccatcgatgagggtgaaggcgacgtcacggcggcccaatggcggagcgcacacgaatctttctggaattcggcggaataccgcgatgaattcgccaacccaaactttccgttgaacgacaactcgctcatagtattcgagcatttcgaagtcgagcaacggttggagtcgaataacgcattaggttaggcgatagcaaaacttttcttcaggcaactctccgagctccgcaacatctgaaggagtgcccatgtccactagagcgacagaagcggaaagcgtattgaaggagcatatgggatatcttccggtatcggaaatggagcgtcgaggagtttcccgcacggagatttcgcgattcgtgcgtgaagccaagcttgagaaagcggcaaagggcttatatgtttcaccgaatgcggagtccgatccgctgttcgaattgcagtatcgatatccgaaagccatttttccgcatgaaactgcgttgttcttgcttggagagggggagcgagccccctgacaccgacgattaccttaccgcaatcatcaggtacggctcgtctcaagaatgaagacataacagtgagaaaggtggccgacaatcgctttgcaattggcctggcgtcggctatcaccatgttcgggcatacggttcgcgtttatgatttggaacgaaccatttgcgatttgttccgctcccgcagcacagtggatccgcaagatttgcaatccgccttccagaattacatgagatccgcgcacactgacttggtcaaactcatgaactacgctcgcgaatttcggctcgtgaacgtgatgcgtccttacctcgaagcggtgatgccggcatggtccaccggcgaattcatcttgtaggcagattcagcatcttgtaggtagctggccttggcgagaggtcattgcaatggcggtattccgatcatcgccattggaatcatctgcctacaagagcacgaaacaccctacaagatgagacgggccagttgggtcagtcccattcatcctgccggttcgcaggccgtaattgtcagtcacaactggtgtacctccctcatccatgcgaatgatacgaatcgcctttcatcccaatgatttcgctctcatggccgatacccgcgtgccgtcatgttccgtaccttggaatcagaagtcgagagatatggtccgaaaccgaatggagcggaccgaagcagggagcattgaagatgggatttctcaagaacttttccgaaccgtttgcgttcgcgctggcattgtggccgtttgtgtccatgctgctgacggtgccggtgctggcgttgctgtatcatcgcgacaatcgcatccgactgtcgtcggccatagtggcgtatggcacggtgctgtacctgctcggcctgctgtgcttcacactgtatccgatgccggccgatgcggcagcctattgcgccgcgcaccatctgacgccacagctcaatccattgcagttcatcggtgacatccgtaccgatggtctcaccgccgtactgcaaatcgcgtttaatatcgtgttcttcctgccgttgggcttcatcatgggccgtatctggcgttggccgctgccggttaccgcagtactgtcattcgccacgtcgctgtttctggagacgatgcagctgaccggcctcatgggcgtgttcccagacattcctgcgtagctcagttggcagagcatccgactgttaatcggacggtcgctggttcaagcccagccgcaggagctcacctgaagccatcggcgtgtcgccggtggcttttctgttacccatcccctgaagctgcttcatcagcgaatcgtcaagcagcgtcgaaatatcagtatcaagaaagtctgctgcacgcacgaggtcggccaaagaccaagatacggaacctcgaatcttctttgatattgcagcacgttgcacgcccagcgcatccgctaaggcggtttgtgatttgccctgcgtcatgagcatcattttgatgttccatgacactgttccttcggcataagcaacggcagcatcggcctcttccgcaatgggcataagtgcaactgttgtcatttatggctccttgaaaagtatttgtatctttaagcgacacgcctatcgtacagcataatttgcgtttcctcaaatgaaacattaatgtgtatcttataaagaatcaagttaccaaaggggaaacatgtcgatgaaggagtggctggtagagaacggtctttcttatcgcgatttcgctgcgatcatgggccagtcgccgtcatcgatctgcaagaaggtcaatggcgagacagcttggcagcagaaggacttgctgtttcttcatgaccactatggtctttcttctgatttcgtactgggtatcaccgttattccccatccggaggaggtgtctgtctgataaaagaatgcccggtcttgatctggtacatcgaaaccgggcgtatgcaacacatccaatgttgaacgattccctagtcgccaaacttttgaatcgttcgcattgccttttagattatggaggctgcacaaatgtctagtgtaaccgaagtcgctgtgccgacttctgattttgatggtaacgcccccgcgaatggttcgcgggacatggcgtctacattttccgaatctttgtattggcgacgttctgcccggcgctacgagctgctgggacttgtctcctggatgctggccgcgttgtcgtgcgtggtttttctggcgattctgcttgccgcgaggaatctgcttctgccgggattcgctttggtgccggtggcctgcggcctggcttgtgtgggttgctggtgcgaccgtaactcgcgcgatgcctgggatttcgctttctggtcccttcacgcggaggtgaggcaatgaccatgaccgttggcgcgcgttccctcgataacgaggagcgctcgaatttccgggactacatgtccctgttgtccctgtccgtggatgcgtcgatgaccgtgagggaggtcatggcggtcgcctatctgatcggccggcatgacgcgcttcgtgacgtgcggaacgcttcgtcgccggctcggacggtgaaccgtcgtctgatccatggcggtccgtcggattgcgtgttcaaccgcggctacgaggccggtgcgggcatggtgtccgacgagatcgacgcgttgatgcgcgacgtggaggccctcagcggcgatgacgcggtgttctcgatgctcaggcatccttcggtgagcgggggtgatgagtggtggaattggtgatcctgctgttcgtggtgctcgcagtggcctgtttcggcctgctgctgccgttcctgcgtctggcagtcggcatcgtgcttctcgcggtccgtctgctggcctccctcgcgcgatcaatgggggcgggccgatgatgcacctcatactcgtgatcgccgtcgtcatcattctcgccgcgtcctatctgctgacgttcgccctgtgccgcgcggccacgcgccgcgacatgcttgaggcccgttggcgtgaggagtcggccggttccgtgagtgaggagagccatgagagcgcatgaaacgcatgagcgtgccgcgcgtcatggcggcttcccgccccatgggttcgcttcgggcctgttggcggcctgcccgtcggacggcagccacgacttctacctgtcgatgatgctcgacgttcccgtgccgcgcgtgcccatgctgcgcgcacgtctgcaagactcccgccgagggggtgccgcatgagcgtgaacgcggtcgattgggcgctcaggttcgcgcccgtggacgccaggcacaacggtgccgctcgcgtgctgatgtgtctggcgaacgtggccgacgacgaggggcgcaacgcgcatccgacgcacaggaagctggccgcgtggtgcaagtgcagcgtgagcacggtcaaacgccacctgtcatggctggaagcgaacgggctgatccgtcgcggcgaccagcgccaggccgggcatttcagcgagtggcaccggcccgtcgtgtgggatctgtgcctggggaaccgtctggagctcgaccccgacttcttcgactcgaacgacatcgactcgacccgaggcggacggccttccacggaaaacagggcgaggggaaaccccggctcacatgtggaccgtggttatggcgacggggacacgggaaaaccccagctcacgggtgaaccacggttcacagctgtgaccccacccccagctcacctggtgagctacagtacgtccctagtacgtaataacccctctgcccctacggggcatctccccgcaagcggagagacctccccggacgatgacggaatccgcgaggacggttcatgggccgacgccgccggagccgaacccccgagcagcgaatccgccggggccggttccgacgcggaggcggtgtgccgcacgatggcggacgggctgcgcgccatgccgccgatgccggtgcccgaaccgttggcccggcccggcaaacgcgaactcgacgccgcccgacggctgatcgcccgccacggcatgccactggtgctggccgtggccgaatgggtgtcgctgccgccttccaagaccgacaagggcgacgcttccggcaaaccgtatgacggtttctggcgtcgcacgctcaccggcccgcgttccctcgcacggcactgggaccaggtatgcctccagatggccgacgacccccacgggcgtcgcctgctcgccggacacggcatcctcgccgacaagggcgaaacggcgcagccgccgagcgtggaatccacgccgaaggtgccgaactacggcatccccgacaacctggaccggcgcgtgtggaaactgctcgacccttacgacttcgatgcgggaaatgacgggttcgaggcaccgcgcaccctgcgccggctgttgaagcgcgtccccgcgaacgatgccgaaggcgaacgcaatgccgtgctggaggcattgcgggcgggccgcgccttcctggacgcggaatccagggagaaggacgacggcttcgggcagcggaagccgtccgggaccgggccggcgtccgtccgtttcggcttcatcggcggccgtgggccgaaggaggtgccggcatgttcctgaagggagaatgcgcggatttccccgactcgtggtcggaccgcatgtgggggcccgacgacctgcccaaccagcgaacccaatacgagctgcgccgcgcggcggtgcggatctgcgaggcctgcccggtcagggccgaatgcctcgcgttcggcatcatggtccgggaccagtacggcatctacggcggactgccgttgagggcccgacgccaggtgctgaagaccgcgcgggaggccggattccggttcgatccgaacgacccgaacgccgaacagcgtcttgcgcgattcatccgcgagaaccccgagatcgtggcggcggcacgcgaacgcgaatgcaaacgccgcaagaccgagcagcgcaacgcacgccagcaacgatggcgcgccaccacacgctcgaccggcaaggcgaaggccccggccgccgccacacacaccccgcccttgcaggacaccctcttctgaagacaatccgatacagataaccggtccggccccataaggacgaaccattccggaaacccgtatacgcggcaaaccgtggaaccgtgcacccgtggacacgggaagccggaaacccgaatgaaaggaacaatcccaatgaccacgaacacgaaaacggtggccttcgtcaacctcaagggcggggtcggcaagaccaccagcgccatcggcaccgccgaagcactcgcccgactgggccataccgtgacggaccgtccgattaacagtcggatgctctgccaactgagctacgcaggaatgtctgctgtgtttgagatttctctcgcgcacaagtcacatatcttacatgcctgccacgaaaaagcaaattacatgcgtgtagggcatgtcgcgctgaattccgcagaatcggactcatcgaatacccactcatacaacatgatgacgatgcggcgatactgtcacgcgaaatttcattgtggataacttcggaagctagaaccacataggtcgttctggctggacatcctgtttcggacccctcaaggtgggtatcaccggcaaagaagccggaatcgcatcacactcacactatggggaggaatctcatgaatgcaccactgttgtttgattggcgtcgcgacgaagcccgacgtgccagcaggcggcgtcagcaggcgcgtcagcgggctcaggaacggcaacggcgtatggatgccataatcgcgttgaccgccgttatcggcctgctgcttgccttgggagtagggctggaatccacgcctcagcatgttgcgcatgcggatactgcggtgaccggagatgcggcatacacggtggaggatttcaccgatatgtctgatttggcgtggcgcaatggcaatcagtgcgaatcccggttcgactggccggtcgacgatccacaggtcgaacaacagttcgagcggccgatcaacccgtgggcaccaggtcatcgcggagtggatcttgttgcggagcaaggtaccgtaattctgtcaccacaggcagggaccgtgagttttgctggcaaagtagctggcaaagatgtggtgagtgtacggcatcgtggaggtgtcacgtcgacattcgaaccggccgttaccgagctctcagtgggggatacgatctcccgcagacagcccgtaggcatcgttgaaggcagctcggaccattgcgaagaccgttgcctgcattggggcctcaagcgaggaacggccgattatcttgattcacagcaatatgcggggagtcgaaaaatcgtactgaaaccgtcatgatttaacggtgattgtcggccggaacagggccgtacggaagagacatcgcaggcggctagcggcgtgacgagtgtgaatcacagaccggcatcggccaaggaaatatatccggggtcgatcagcgcggacttgagattgctggcgctgacagccagcaacggttcgctgatggtcgggatcttcttcacgccgcctacctcggagttcctgattgaaggcatggaattcagcgcttcgtccttgttgagcttggcgcaggcctgagcgatatccgtggcgatggtctgtctgtcttccatgccggtcatccattgcttgccattgacgatggatgggatgttcgagacatacgcgccgtatccggttactagaggccactgcgagtcacggtccttgtcggaagcggaggtgtcctcgtccgcatcgtcatcggaactggatgagtcgtttgcgttgtcgttttcaggggatttgatcgggtccggcacggcgtcgcggctgagatccttcttgccggtgatattgccgacaatgcccgagatggtgatctgcggattgatatcggcggcagagccggtgtatcccagatcgtccaattccttgacgacctcggaggcgatgtagtcgttcatcgtgatgatgccgtcaatacgggtgagtgtggactgtccgtcggtttttgccagacgcttgtcaagcactttcgcagtggagccttccttagcggcatcgtaggccacggcttgccaatcgttttccgtggatttgccgtccaaggtgcctgaagggctttccacaacgcccttctgatagtaggagcccagtacctgccagataccacggaacgcctcttgggcgaacgtggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtccgagaacttgacgaaggcgtccggcttatatccctcgatactgttgccgagcaataccacatgcatgccggattccttggccagcttgagcgatgagaccagccggtccacggcctgcgcctgctcgtccgatgcagtgctgtcgctctcagtgttggacgagtcgtctttggacgagtcgtcttcggaagattcaccgtcagaagtagctccctcatccgtgacatcgttggtgctcaggttctggctcacgtaatcgccgtattggcgagtggaagcgtcggcctcgactactggagccacgagcaatgtcatgttgtcgggcgcgatggcaatgtcggaatcgtccgtggtgttattcgaaagatgatcgaccacaaagtcttggatggcgcggctttgcttatccaacgagtcggacgtcgtatgattgatatcgcctttcttgaaaccggcgtcgaccagagccttggtcaggtcaggcaccagcttcgcccacttgttcagtggcatctgctggttcagcgtgatgccgtccgaaggtgtgaacacggccacgccgccggcagaattggacgtcaccgtggtctgaccatctacaacggtcttattgtctgaggtgcacgcggtcagtgacagcaccatcgcgcaggatgcgataatggcggcgagcagggtggttgagcggcgtgcgaacaccataagcggcgaaacctcctcaagcgggcgtgaaaacaaactgaatcacgattctagtaggccgtatacgaaaaagtcccggaccagtggacaaatcgccacatatccgggaacaattagaagtattacgtgcgtgcatcgaacaactgtcatgattatcgtgctgaggaacattccagatgaagcacgacaatcatgacagtttgcgacatgacatggcccatgtaggtccgcacgatgtgttcgatgatttactcggccagagccttggccaggttctcgtccagcgcgttcatgaagccgtcggtgtcgagccacggttcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggatgcgatcgggttggtggaggtcttctcgcccttctgccagcggcggtagtgacgggtcacggtgccgtgcgccgcttcggcctcgacggtctggccgtccggggtcatgagcacggaggtcatgaggcccagcgaaccgaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacctgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacctgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggctacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacaccgacatggtgcttctggatggcgtgggcggcgtcgatggtcacctggtcatcggtctcgtcgcggtgctcgatgcccagatcgtagtagtcgaggttcacgtcgaggtacggcaggatcagacgatccttgatgtccttccagatcacgcgggtcatctcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggctggaaaccatgtctcaggaaattgaaatcggtttgggcaaaaaaggccgtctcggctacgcactcgacgatgtggcaatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggcgcgctcggcgtgctcgatctggaaggtctgtggacccgttacgaggatccgaccccgctgttggacgaaatcgccggactgccggccgatcaggccaccgagcgtatccagcagatctatgccgagccggtcaagccggagctcatcacgcaacgtctgcacgagattcgcgccgccggtgtcaccgtggccggcgcgctctccccgcagcgcacccagcagttctactccaccgtggtggacgcgggcgtggacctgttcgtgatccgcggcactgtggtctccgccgagcacgtctcctccggccaggaaccgctgaacctcaagaagttcatctacgaccttgacgtgcctgtcatcgtcggcggcgcatccaactacaccgctgccctgcacctgatgcgcaccggcgcggccggcgtgctcgtcggcttcggcggcggcgcggtctccgccacccgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttctgaagcccgccaccagacgctgccgcgtggctaccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattgccccctgaaaatgggggtttgccctccatgcaggaggcttaacttgcccgaaggcgcgctcaagtagtttgacttggcgcgcctttcgtgatgttgtagtacagacgctcgccgatgatggtgagttgcaagggggcttgaagggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcatccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttctcgatggatgtgcatctatgccgatttgggctgaccagacggccccgcccgcacaccgattcctacgctggtagcggaagacggttctgccgtgtcataggctggttcgcctatagtagtgaccatgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgttgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacgccaagcgactgctcgccgatatccgcagcttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgagatcggttcggtcggcaagcctgggcctggcatgggcgtgcgtcttggcgaagacgatgaaattgagctgaccggcccgaacgtgttccttggctactacaagcagcccgaactcaccgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgtcatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccccgagcatgaaagtggtgcgtcccaaggtattgcagcgctacgccaccgtcatcgaggaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgctgacaatgccgctgacaccggcagcaagccggaccagccggctgacgagaagaatgaggagtaacgagaagtggccatccgtgagatcagggtcgtgcccgacccagtcctgcgcaccccctgcgatgagatcaaggaaatcaccccggccgtgcgccgcctggttgacgacctgttggaaaccgtggacgatccgggccgagcgggcctgtccgccaaccagatcggcgtgagcctgagggccttctcctacaacatcgacggcaaggtcggctacgttctgaaccccgtactcgaggagaagtccggcgagcagtatggcgatgaaggttgtctgtccgtgcccggcttgtggtacaagacccgtcgtgccgactacgctcgcgtgcgtggcatcgacttggacggcaacgaggtcgtgctcgagggctccgggctgatgggccgtatgcttcagcacgaatgcgaccacctcgatggccacgtgtatttggatcgcctggaaaaggaagaacgccgcgaagccctgcgctacatgcgcaatcgtcaggcgaagtagtccatactcggctcccgctggctggagccgtcgaacgtagtgagactgagggtggttctgccggtaccgcccgtgactcccctcagtcgcctacggcgacagctcccctcagagaggggagcctgtttttttttagtaccggctccgtgctattctcgaaactcgtgtgccacccggcaacggacgcagtcgctggtgtccagagccacccaatattgtcaaccggcacacaacaaattcgcgtcatgctcgcgacggcttgtgtcggtcggctgcacaactcgtgaaaccgggggagcagctgcacgcaggtgcgcatggccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggcccacaacggcaccgtgctcttcgtcggcaccaagaagcaggctcaggaagctatcgccaaccaggccacccgcgtgaacatgccctacgtctccgagcgttggctcggcggcatgctgaccaacttccagaccgtctccaagcgcgtcaaccgcctcaaggaacttgaggaaatggacttcaccgacgtgcacggttccggcctgaccaagaaggagctcctcctgctcgagcgcgagaaggacaagctcaacaagcagctgggcggtatccgcaacatgaaccgcaccccgtccgcgatgttcgtcgtcgacatcaccaaggaagccctggctgttgaggaagctcacaagctgggtatcccggttgtcgccatcgtcgacaccaacgccgacccggacaccgttgagtacccgatcccggccaacgatgacgccatccgcggcatcgaactgctgaccagcctgatggctgacgccgtcgccgaaggtctgctggagcgctccggcgccaacaaggccgagggtgaagccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaataagcgcttcccatcgttcacgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggtatcgccgcagccggcaagcgtgaaggccgcaaggctcaggaaggcaccatcgcctccaaggtcgtcgagaccgccaatggcgagaccggctacgccgtcgagctgaactccgagaccgacttcgtggccaagaccccgaagttcgtcgagttcaccgaggaagttctcggctacgccgtggacgccgacgccaactccgctgacgagctgctcgaggccaaggctggcgacaccaccgtcaagctggctgtcgaagaggccgccgccctgttcggtgagcacgtcaaggtcggccagttcgccaagatctccggcgagcacgtcgaagtctacgctcacaagaagtccgccgagatgccgccgagcatcgtcgccatgatcgccaccgacaaggccggcgccgccgtggctcacgaagctgctctgcagatctccgccatgggcgccaagtggctgacccgcgaggacgttccggccgatgtggtcgagtccgagcgtcgcgtggccaccgagaagtccctggccgagggcaagccggagaagatcgttccgaagatcgtcgaaggccgtctcaacgctttcttcaaggaagtcgtgctgcttgagcagccgttcgtcaaggacccgtccaagaccgtcggcgacctgttcaaggaagtcggtggcaacgccaccgcattcgctcgtgtcgaggtcggcaagggcgaagaggagtgaacctaaggcttactccacgcgcttagcgtaatttcaacgaaacgccatccggttattcaataatcggatggcgtttcgctattccaagggtgtcgttgctagggggtgtcgtcgtaaaccgatacgcttgtctacggataatttcgcactttcggttttgagaaaggcacaatatgactgatagcgacaatccgcgcagagttctgctcaagctttccggcgaagcattcggtggtggcaaggtcggcatcgatacccaggtgattcgtcgcattgccgaggagatcgttccggccgtacaacagggtgtgcaggtggccatcgtggtcggcggcggcaacttcttccgcggtgccgaactgcagcaggccggtatcgatcgttcccgtggcgactacatgggtatgctcggcacggtgatgaactgcctcgctctacaggactttctggagcaggaggggcaggccacccgcgtgcagaccgccatcaccatgggacaggtcgccgagccgtatattccgctcaaggccatccgtcaccttgaaaagggtcgcgtggtgattttcggcgccggtgccggcatgccgtacttctccaccgacacggtttccatccagcgttccctcgaaatccactgcgacgaggtacttatgggtaagaacggcgtcgacggcgtctacaccgccgacccgcgcaaggacgagaacgccaagcgttttgaaaccctgagctacaatcgcgccctcgtggacaatctggccgtcatggacgcctccgcactgtccatggcccgcgacaacaagaagcgcatccgcgtcttcggcctcgaagagccgggcaacgtgacccgcgccctcgtcggcgatgaaatcggcacgctggtctccaccgccgaatcgcgcgtggccgagtaagccgcaaacgcccacaatcgaatcaagcgttcatagacgaacaacactgacgaacaccaacacacaaggagtgaatatgtctcttatcgaccaggccaaggaacagatggccaagaccgtggaaaacaccaaggaaaacttctccggcatccgcaccggtcgcgcaaacccggccctgctcaacggcatcaccgtggactactatggtgcccccaccccgattaaggccgtcgcctccatcggcgttcccgaaccgcgcaccctgtccgtcaccccgtttgacgcttcccaggccggtgccgtcgaaaaggccctgcgcaactccgacctcggcatcagcccgaaccgtgatggcaacgtcatccgtctgaccatgccggaactcaccgaggatcgtcgtaaggaatacgtcaagctcgccaagggcaaggccgaggatggcaaggtcgccgtgcgcaacattcgccgtaagaccaaggaaaccatcgacaaggccgtcaaggacggcgagatgggtgaggacgaaggcgatcgcctgctgaaggatcttgacaaggtcaccaagtccgttaccgacgagatcgatactctgctggagaccaagcagaaggagatcatggaggtctgattcagaccaggtccggagaattatggaacgcaacgaacaaccccatgaagaggccgaggagacgctcgaccagatcaacaagaagaccggccgcaacatgccgcaggccatcgccacaggcgcggcactggtcatccttattgtcgcgtgcctgctgctcagcgtcgacctcttcgtgctgctggtagtcgtgttcatgattctggcgctgtgggagctcagggtggacttcgccaccgtgggcctgcacctcccggtgtttatgctgtggctgtgctcgtccttcaccctcattgccacctactattccccgtaccatctcatcacgatgtcgctgagtatcatcgtgtcgattattctggtcgccatcgcggccagcgcaaaaatcagcgtcggcaaccgcctatctctggcggttgccggcaaactgtccaacacggatgccagcgcgcgcctcgaatcctcgtttaatcatgagggcggggaacagcatcattcccggctcagccatgtggctgtgtccgtgcttaccgtgttgtacattccgttgttggccagctgcgtcatcatctcactgacttttaatgggcatccgattgcacacgccatcatgctggtgttcctacccgccctatccgatacgggcggtttgtttgccggtgcctggctcggcaaacacaagctcagcccgcgcatctcgccgaagaagtccgttgagggccttgtcggctcgatgctcttcgccatggctggcgcatttgccgtattcgcatgcacgtatgatgcctcgaaatgggccactcgttggtgggtgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccgttcacctgcgccttgctgtggatcaccggactgtgattcgcatgtctcgtgcatgaacaatgtggcatcgtgtgtatatcgcacggtgccacatgccatatatggggaaatcatcgttcaatatgcgttcgctatgggctaagacatgggccatctgattcgtatgcggcacgccgtatggtggattctgatattactattgcatgtttgactattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcatcgagaaagcggccgaactcggattgccgaagttccgagtcaagcagctcgccaaccattactttggccatttcgatgtgaatgccgccgaattcactgattttccggcagccaagcgcagcgaggccgccgccgcgttcttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatggactgcccgttctgcgccaccggcaagcttggcctgacccgtaacatgtccaccggtgaaataatcgaacaggtgcgtgtggccgccaagatgatgcgcgacggcgaagtggccgggggagagggccgcctgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaataccaagcaggtgttggatgccgcgcacgattattggctggcctccaagcgccgcgtcagtatcgaatacgcgttgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgcgcgggcatcaccgccacactgcgtgacacccgcggtcaggatattgacggcgcctgcggccagcttgctgccaaggagcggtagctacttcagcgcatccttgattgcgcccacgaagtagtccagatcgtcgggcttgcgggacgtgatgagcttgaagccgttggcgtcgtccacgtgcagctgctcgtcgacgtaatggccgcccgcgttctcgatatcagcggcgatatagcggcagggcgcggcggtcttgccagccaccagacccgcgttgaccagcagccacgcgccatggcagatcgcggcgatcggcttgccttcgtgcgcgaactcctgcgccagcgtgatcgcatcctcattgacgcggatacgatccacattgcaggtgccgccgggcaccaccagcaggtcgtagtcggcagcctgcacgtcggacaggcgcgcgtccggggtcagcgtttcaccttcgtagcggtcgtgctgcaccgtctcacacgggtccaaggtagtggcggcaagcgtcaccttgacgccggcggccttgagatcgcgcagcgggcgcgtcagctcggtctcctcgataccccagttgttgacgatgatcagtaccttgctgttttcgacagccatgccaatctccttgattcggcggacaacttccacgagccattctctcacgccgagcggctgccatgtcggtgctcaatatgatgattctcatattccagaaacaggtgcggcgcatgtaacgggcggtaggtagtctgaaggactgtaatgcaaagccgaacaggggagtgaagcatgtcgttggcggtacgagtcatcccgtgcctggacgttgacgccggtcgcgtggtgaagggtgtgcatttcgagaacctcaaggacgcgggtgacccggtggagctggcggccgaatactaccgtcagggagccgacgagatcaccttcctggatgtgaccgcatccagctcccaccgcaacacgatgattgacgtggtctcctgcaccgccgaacaggtgttcatcccaatgactgtgggcggcggcgtacgcacgcccgaggacgtcgactcactgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggcggccgcaaatccaccggtattgatgccatctggtgggtcaagcgcgccgagcagcttggcgccggcgagattctgcttaactcgatggacgccgacggtaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaaacgaatacaccttgctcccgctgggcgaacaatccagtgaattgttcgtggcaatgcgctatgcgcacgtcgcacataatccgggagctgtcagcgaagctgactgagggtggtccacaaaaagaagataggtatgacagacactacatacgacaattccactgaactcgatccccgtattgccgcacgcctgaagcgtgatgccaagggtctggtcgccgccgtcatccagcagtacgacacacacgaggtgctgatggtcggctacatgaacgacgaggcattacgccgcacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggtgccgcctgccacaccggcaagcgcagctgcttcctcgaaggcggccccctgcccgtggtcgaaggccatcgcccggccgagcagtagaacgggctttcctgactgagggaagccgagcgaccgcgtactatgaaacaagatatcgagttgtaagcaaaggagcgaatatgagcgaatgcagcgtcaaacacctgaagtggggcgccacctggcccagtcgcgaacagttccacgaactggccgacgccggctgccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagcttcatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggcccctcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggcttcggacgagtcccgcgtcaacatcctggacgaaacggtcgcccaacccgagctgcgcttccgcaccgagaagagccactacgagcaggccgtcgaacgcgccaagcagcacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcacgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggcgcgcctaagccgcgcgcagtcgaaatcatcgacgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgaatccatccagatcgccgcccagttgcgcgaactgtaacgttcaacgcatagcgatgcccccgctgacagaagttgtcggcgggggcatcgctgtctgtacgttagtgggtttcgcccatgatgtcggtggcgtcggtttcggtgctcacagcggcttcgatggcagcttcgataccgtgcgccatggtcgcgatcaccataccgggcgtcgcattcttcaccttgccgatcagctgcgcgtaagcgtatggacgcatgagcgtcggttgagcccggtcggcatggtgttcgctatgatggacagtcggactttggtaagagacagtattcgtaacaggcaagtaggttattcatggctattgaggtgcagggacttgaaattcagatcggcgcgcgcacgctgcttcaccccaccaacttccacgtggccaagggagacaagatcggtctggtgggccgcaacggtgccggcaagaccacgctgacccgcgtgatcaccggcgacatgctgcccaccgccggcaaggtgcgcgtctccggcaagctcggctacctgccgcaggacacgcacgcctccgatcccacgcagaccgcgctcgaccgcatgatgagcgcgcgcgacatcgcaaccatcatcaaccgcatccgcaaggccgaaaaggatatgaccgacccggatccggacgtgatgagcaaggccatgacccggtacgacaaggccatgcaggacttcgacaaggctggcggctacgcggcccagtccgaggcgatctccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattctatcgaatggctgcgcggctacttgaagaagtacgagggcggcttcctggtcatttcccactccaccgaactgctggacgaagtggtgaacaaggtctggcatctggacgcgcagctcggccagatcgacatgtattcgcttggctggaaggcctacctgcaccagcgcgtggtggacgaggagcgccgccgccgcgaacgcgaagtggccgagaagaaggccgaccgtctcatgaagcaaggcattcgactgcacgccaaggccaccaaggccgtggcggcgcagaacatgatgcgccgtgccgaaaagctgctggaaaacacctccgaggcgcagaaggccgagaaggtggcggacatccgtttccccgagcccgcgccctgcggccgcacgccgatcatggccaaggatatttccaaggcctacggttccaacatcgtgttcgccggcgtgaatctggccatcgacaagggctcgcgtgtggtgatcctcggctacaacggtgccggcaagaccaccacgctgcgcctgctggcccacatcgaggagccggacaccggttctgtggaatacggtcacggctgcaagatcggctacttcgcgcaggagcacgacaccttggatctgaacgccaccgtgttggagaacctgcagcatgtggcgcccgagctcgataacacgcaggcccgttcgattctcggctcgttcctgttctccggtgacgacgcgatgaaaccggctcacgtgctttccggcggtgagaagacccgtctggctctggccacgctggtcacctcgcgagccaacgtgctgctgctcgacgagcccaccaacaacctcgaccccgcttcccgtgaggagattctgaaggccattgccaagtatgagggcgccatcgtgctcgtcacccacgatgagggcgccgtcgaggcgctcaaccccgagcgcgtgctcctcatgcccgacggcgacgaagacctctggaatgattcgtacctcgaactcgtagctgaagaatagtagtaaactcgtagccgaagaatagtagtaggagaggtctgccatgccaaccacaacaggtaagaaaatcgccatcgtcaccggcagcgcgctgggcttgggctacgagctcgccagccagctcatcgccaacggctggctggtggccggcgtcgacttcaatgccgaacgtcaagccgaactgaccgcgcagtggcccgatgactcctaccgcgccttcgtcggcgacatcaccgacgaagcgttcgtgaaagaagccgtggcggatatcgccacgctcggccacatcgatttgctcatcaacaacgccggccagccttcgttcaaggtgcccaccgcctacgaggccgccgacgtcgacaaatgtctcaagggactcaaaggcatgattctgtggacggtggaaaccctcaaggcctgcggcgaacagaatgtgaaaatcgctcagattatgagtacggccgccacgcgcggcaacgcgaacgaaagcgtgtactgcgccaccaagtggggcgagaagggctataccaagagtctgcaggccgcatacaagggcaccagtgtcaaggtggtcgccgtctatccgggcggcattgataccgctttctaccgtgacagtcgcgactacgtctccgaggccaagcagcacaccttcatgcagcccggtccgctggccgaagtcatcctcttcaacctgatcaacgaggccaacctcaccgtcaccgacatcgagatcaaccgcaacagctgagcctgctagtctgagatttcagcgccttggaacatacttggtgccaaggcatttcgcgtgtggagagcgaatgcacatcagtgacgatgagtttgaacgggcaattgaacaggtgttggatgatttgcctgaacggtttgcgcgggtgctggagaatgtcggcatcgtcgttgcggacgaacccaatgagcgcgaactggccacaatgagcaatccgtgcggtgagctgctcggactgtatgagggcatacccgtcacgaagcgaactacgggctacagcggcgtgatgccggacgtcatcaccctgttcaaggggccgcatgaacgcgtatgctcaacacaggccgagctgcgccaacggatccgcaaaaccgtgttgcacgaaatcggccattttttcggcttcgatgacgagtatctgcactcgcacggctactgaagcgatgctagtttcactagcggggagccgccatactgccgtatgttgccaggtctactgcaagtggtgcaacgcacggatgatggcgcaacggtcctcgacggttccctcgttggcgcacatggtggcgtaccaacgcggattgcgcaaggtctcggtgccggtggcctcatccgtggcgacgagcgtgtgcagatcgttggcgtactggaaatgcaggtggctgagcagcccgccctcggcgaacgccttgcgcgaaggcagcggattgatggcaagcagccagcggaacgggctgtcttcggcggccggatcggtggtgtggaacacgaaggtgggggagccttcgagaccgtgctcgatgacatggtcgatggtgtattcgtaggtgtcgaggctggtgtcgtcctcggcgaaccattcgatggcgagcgcggcatcgtccgtggagccggattcagcggccggctcgttcacacgccagtagccgatatggatgatgttctccgggctggtggtggagcaggccatcgaccagaacgtcctgatgccgcgcgcggccatcggggccgtcttcgggttggcgagcaccgcctgctcggcggcttcccaggtctgctggatggcggcgtcatccgaatcaatgtaatgctcgaagctttcccattcaccgagccagtcggtgatgtcgaaggccgtggaatccgtggtgttgctggcggtcattgcgcgttcctttcatgggtggatgtggtggcgaaattggtagaggcattagggctggggctgctggcatctgggttactgacatgcgagccgttgttcccggaatcgtcggcgccaagattgacaatgcggtcgcaccagccggcggcgagctcctcatcgtgggtgaccacgagaatcgccttgccttggctcgccagttgccgcagcagttcgccgacctgctccatgtggtagcggtcgagtccgctggtgggctcgtcaaagatgatgaggtccttgccgcacatcaatgccgagccgatggcaacccgctgcttctgcccgccggacaggctcatcggatgccgttcggcgaacgctgcaaggtcaagatcggccatgacctgattggcttgagcggtgatgccggcatccgtctcgtcgagtccgatgagcagttcctcgcgcacgctgtcggagaacagttggtagttgacatcttgcatgactaggaatccggcgcgggtcaggtcgcgcggtttcgcgggcacgccgttgagctcgatgcggcccgaaacaggcttgatgagtccggtcaacgtgcgcacgagcgtggtcttgccgcagccgttgttgcccatgagcccggtgatttcgccggcacggaaccgcaggtccgggatggcgcgggtgaagccgtccttgcctttgtatccgatggtgaggttatgggtgccgagcaatactgaagtgcactcatccgcggccgggcttgaagccagcgccgcaatccggcgtcgatacggttgcaggtccaacgcccgcaatcccatggcggccacgcagccgggggagagggacaggaattcatcggcctcgtaatcctgcacgatatgcccgccgtcgaataccacgtaccggtcggccacgccgttgagccatgcgagtcggtgttcggcgattacgatggtgagcccttcgtccttcatctgctcgatcatggcgcgcatgtccgcgatggcgttcgcgtcgagattgctggtcggctcatccaataccacgaccctgggccccagcatggtggccgccgccacggcgatgcgctgcttttggccgcccgacaggtggaagatgctgcgatgcagcagatgcccaatgccaaagcgctcagccacggccgtgatacgacgattgatgtcctcggccggcagccctatgttttcggccgggaaggcgagctcgtcggtgacgttcgcgttgaaatactgggttttcgggttttggaacacgctgccgaccagcggggtgagccggtcgatcggcacggtctccacatccagcccgcacgtggtctggttgccggcgaacgcaccatggaagaatgaggggatgagcccgttggcaacgcgcgtatagctggttttgccgcagccgctcgccccgcacagcacgatgcactcgcctgcgggcacggtcaacgtgatgtcgcgcaatgccggctctgcggcatggtcataggtaaaggagatgccacgggaggcgatggttcccgcagacgtgtcgagtgggccacccttgccggtcccaataatggcagttgcattcggctgcgattggtttccacccatcagatcacccccgcgatatcgagcgcgagcggcaaagtgaccacaatcatgaccagccagtcgaccacggtcatacggatcagcgtgcgcgaggtgtgctcgccctcacgcccgagccccttggtcagtgccgccaccgacaggtcctgtgccacattggtggcgttcatcagcagcggaatcagaatgtattccaacgattgggccgggtgacgaaccagcccccagccgccggaggcgatgccgcgcaacgccatcgcattgcgaatctgccggtaatcctcggcgatggtcgggaagaagcggatgaccaccacacagggaatcaccacggcctcaggcacgcgcatacgccgcatcgcgcagatgaacgcgctcgcggacgtggtggtgaacgtatacgcgccggtgatgaaacagggcagcatcatcgtgacgcccacggccagcgcggagaccacatgcagccacggcagtcccagggcatcggggtcgagcattcccagcgcggtgagtacggcataggtcacgccgaagttcaacgcggttcgccatcgggcggccgccagcaggggtagcaggaacagcacgaccatgacgatttgcgtggcgagccctacatggaagaacagcatgaggttcgccaccagcagaaggtagagtttcgcgcgcggatcgagcgtccggcgggcaggattcatcaggcgataccggccttgatgaagtgcttcttcatcatgcgctggtcgaaccagccgccgagaaccgcgcacaccagaatcgcgatcatcgagatgaagaacgtgccggtgttgatgttggcgaatacgccgtcgatgtaggctgcgtccttgccgcgcgcctgcaggctcgccacgtaggcgtccttcatgaaccacaggggcaggatcgggccggtcaggccgtaggagaacaccacgtagctgacgagcagtagcgccttgctcttatacttgccggcgcgcgcgatgaggtcggccgccaccgggaacacgatgctggcgatgaacgaaagcacgaaatgcccggagatgaacaggaacagtccgatgatcacgcccatgacggtgatgccgccgaatttgccgaggcgtgcggccagcagcatgtacacgcagccggagatgagggccgtgatggcgggcaggaagatggagccgaagccgctggtgaacagggtgctcaccagtgtggcgatgcacaccatcacgaagtacagggccgcaaacacgccgatggtgatgaggtcggagacctccagtttgccggatttggcgggcttgttgagctggtcagaggtttcggcgggcgtgttcggtgcggtcacgatgttttccgtttcgtatgcattgacaatattcctctcgccaatctaacgatgatttcccgcagaggcaatagtctgtctgtgattttttagcatggcttggcgcccctccctgtgggggggcgaagggcgtggcgcgggcggggtgtggttcgcggctatcggctagtatggtgcggtcacgacagagggaggcatgctgtggccgatgtgatgcgggagctggaacggctgcgaccggtgtatgagacgggcgtcctgcggttgctgttgcgccagaacgcgatgctgtacgtgtcgctgctgcgttccacgttcgacccgctcaccggcgagctgccgcgcgagaccgtggaggagcggttcgcgcaaagtctgagcagtctggccgacgccggcgagtatgcgccgcgcgaggaccagaccttcgccgaggccgcccatcagatcctcgccgacctgacccgtgaaggcgaaggcgactacgcctggctcgccaactcgcatgatgcggcctcacaccgattcctctaccgtttgacggcccgcgcccaccgcgccatcgaggcgctgagcaggctcgaagacgaatcacgcgccctgtccggcgcgcaggccaacagcatcatcatggaaatcgagcacgcgcgcatgcagctgaccgccgaccccggcgagcgcatcaaactcctcaaccgtgaaatcaaggaacgcaagcacgagatcaaacgcatccaacagggcaagcagcatgccacgctgagcgaagcccaggtggaggacgtgatcgccgtgatccacaacacgctgcgcggcgtgcccatcgacctgcgcgaactcgtgctcgacgagcgggacaacggcgacgccttgcgtcggcgcatgcaggccggcgacatcagcgtggacgagaacctgacccgctaccacgatgaataccgccgctcgttccgcgaatcagacagcggccgccgcttcgaggacgccttccaggtgatcatcaccgacgagggtcgccagcaaatcgacgaagccctgcgcgccatcgccaaaaccccgtatctggccggcgaatccggcgtgctgctcggccagatccgcgacgaactggcccgcatctacgacggcatcgaagccgtgcgccgccagatgcgcgtctccgacgaggcgatcagccggctcgtgcgccagcaaaccgacactcgctaccgtacgatgctcacccgcttgaaccgactgtacgcgcgcctcaacgcggatgcgaaaacccatatgggagacgcctcgcgcccgtacgacacggccacctcggacgcgctgttcgcgccattgccgatgcgcccggccaaatccatgacccgcgccaccgcacccggcctgagcgacctcgccgccgaagccccgcagtcgactccggtggccgatctgcgggacatggtcaacagcggcggcccccgactcctgcgcatggtcagcctcatccggcgcaacccggtgaccgttgacaggtccgatgacaggcccggcgcaaccctcgtggacatcgccgccagcttcaaccggctgcccgaaagcgaacgccgcgaaagcgagatcgtcggcttcctgggcgggctgggagccgtaagcggcaacgccatcgccgacgagccgtccactgacggcgtcggcgtcggggtcgacagcgacatcgccaccgagccggccccggcgcagcgcggcgataccgcgacctggcattgcgtatcgatcgacggcgagccccggaactggatcactagaccggtgctggccgacatggacgagctgagcatcattgtggaggaaggatgaccgtggccgaggaacacgaggaacacgaggaacacgaggagcatatggacaacgccaacccgtacgccctgttcgaaggcgacaccggcgacatgccggccgaggcacgcatggccgccatcgccctcaaacgtgaccgctatatcagcggacccacctacgacaccgtgctcgacaaccgcgacgccgtcgtacgctccctgaacaacgacctgctcgacttggtgatcaacgaacgctaccgcatcatgtacgccacgcccgtggccggcgacgacgtgaccctgcgctcgctcaaaacccgtgtcagcctcaaacgcgaggaggccgcgctgctcgccttcctgcgcatccgcgtcctcgaatacgagaacgtgcacgccgaccccgccgactggctcgtcagctttgaggagatccgcgccgcgctcgccaccggcgccggctatctggccgcccgcaacgacgaggaaggcgtggcaaagcagatcggcgccatcgtctccgcgatgatcacctacgggtatttggtgcgcctggacgacgaagccatgtaccagatcacgccgctcgtgcccgtggtgctcgaccgcgaactggccgacacctggctcgacgtcgcggaacacggcgacggcgacacggaagatgacgatgacgacgagaagggagccgaatgatgcaggcgacagacgtgcagatgatcgcggaccggtggatgctggaatcccgccgactcatcaactggggctcctatgagggctaccacgaattccgcccctccacggaccacaagctgccggtgaccctgctcgccggcgccagcgaatccggcaaatccacgctggtcgacgcgcagatctccctgctgtacccaaccggtacgccgttcaacaaggcctcgaactccggccgctccgaacgcagcgactacacctacctgcgcggcatggtcggcgtgggcagcaccgaaaccggcgacgagccgctctacctgcgcggccgcgacgagaacggcgcaccgcaacccgtgtggggcgccatcgtggacacctatcgcaaccagaccaccggccaggtgctctcctgcgccaaattcctctacctgatgcccggcgacggccgcggcgacgtgcgccgacagtacgtggtctggggcaagcccgtggaccccaggcgcatggaccaataccgtgacgccccgttcacgccggcccagctcaaagccacctaccccgactgcctcacattccccagcgccgaagcgttccacacacacatctggagcgcaatgggcctgagcgaggccgcctgtcgactgctgcacaagatccagtccgccgacgcgccctcccggctcgacgacatcttcaaacaaggcgtgctcggcgtgcccgaagccctggacctggcccgcaccacggtcgaggactacgaacgttacgacgagaacttccacgccatggacgagaagacccgccgcatggacacgctgcgcggcatccaacaggcctacggcgaatacgccgccgcacgcggcaaggcccgcgccttcgaaccggtcaagccggccgtcgacggcacggtaccggccgtgctgcgcgactgggcattggcccgcatgcgcggcgaagtcgccgtccaactgcccgccgaccgcgccgaacaacagaacagcgaggcggaagccaagctgctgcgccgccgaaccgaagacctgcgcacccgtctcgacatgatccgcggccagatgcagggtctggacggcggcaacctgacccgactcgaactcgaactcgaccaggcccgccgcaccctcgaagacgtgcaagccaaccgaacacgaatcgaacaaacgttcgcatccatcggcgagacgctgcccggcgacgaacaagcctggaacgaacgccgcatcaacgccgtgaacttcaaacgcgaatacaacaaacgagacggcgaatgcgaggaagccctcaccgccgccatcaacgcgcgggccggcgcacgcggcgacctcgaacgactgcaacgcgacttcgaccggcaacgctcccagcgcacccgcatctcccagcagatggacgaaacccgcgccatgctctgccgcgccaccggactcacccccgccgaactgccgtacgtggccgaactcatggacgtgaacgaacacgaggaagactggcgtctcgccatgaacgtcgcctacgcgcccatcgcccagaccatcctcgtcgacaagcgccacgaacagggcttcgccgccaaagtcagcaccatcgacccgcgcaccatgccccgacgcacctggcagttcgtggacaccgcacgccactacgacgacaccggcgcgcacgcgaacatactcaccggagaacaggacggcgactggctgtccggcaaactgcgctaccgcgacgactcgcccttcgccgactggctgcgctcgcagacccaggacgaacgattcgacgccctatgtgtcaccgccatcgacgacaccgaccgcaccaaccgtcaggtgcaggccgacggtcagatcaaatccggcgcacgcggccagcacggcaccaaagaccgcgcccaggtcatcggattcgtcaacgaaacctacctcaacgcgctcgcagcgcaggtcgacgccgcccgcaacgcgctcagccaagccgacaccgactacacggccgccaaaacacagtccgataacctccaccgcgaactcgaactggccaaccagctcgcctacacgtcctgggagcgcatcgacatcgccggcgcgcaacggaccatcacggacacgcaggacgccatcgcatccatcaaaaacgatcccaagctcgccgaactcgccaaacagcgcgacgaactgaacgccgaactcgaccgtgtggaacgccagcgcatcgaatccgaccaggccgcggcccgcgccggcagcgccgtcgaagcggcgctcatctggctgcgcgaccatgccgacaccggcacgacggacgccgccggtgccaccgccgacaatgacgatgacgccgcgtccgtcccgctgccggacgaagtcacggcggcgctcgccgaatcctacgacaaccgattcgccggactggcggacgccgccatgcgcgcgcacatgatcatcggcgcgggcgcggcaggaacgcaggcaccgggggagagcttccccgaacgcaccatcgccggcatcggcaaggacatggcctcccgcatcaacctgctgaacggccaggccgatgccgcacgcaccggcgtcgaatcgaagatgagcacctacatcgcgctctacgcggccgacgatgattcgctgaccgccagcgtggaggactaccggtactatctcgacgaactcgccagcctcacccagctggccgcggttgccgccaccgacgccgaataccggcgctgcctcgaacagctgctcaggagcttcctgaccatcaaacgcgccatcgacacggatgccagcgacatccacgaccagcttgaccgcatcaacgccatgctcaaaggccagcagttcggtcccaagcacggcagcctgtccctgcacgcggacgtgcgccgtcccgagcgcaccttctgggcgcagctcatccgcgtcatcggcaccctgaacgattggaaatccgccgacgtcaacgattccgacgcctcgcgcaaggctttcgcggcctgcgcgccgatggtcgggctgctgcgcgccgaactcgcgcaggtcaaggacgcgaacggcgtgaaaagctacggcgcccgcaacctcgacccgcgctgccgctcgtccttctacgccatcgtgcatcatgccgacggcccggatgaacgcatcacctccaccggcggccgttcgggcggcgccttgcaggagctcacctcattcgtatacggcgcggcgctcatctacctgctcggcggcggcctgaccagcgagccctcgtacaccacgctgttcctcgacgaggcgctcatcaaggccgacggccgttacacgcagcgcgccctcacggtgctgccgcgcctcgggttccaggtcatcgtctccgctccggaaagcaagaccggcgaaatcctcgaggtctccaccaaggcctacgtgacctacaaggaccccgacaccggcctcacctccctgcgcgaggccgtgctgcatcagaatgacatggacgatgaatcatcgtcggatatattgaaggatgacggggttgccgaatgagcagtcccggcgtcgccggtattaagacgattcggttcgactcgacgatgttcgaaagcaggtgatgggaactatggccggcatgaaagacatcgctgcgatcaccacatgcgtgaagaaacatatgcgttcacatatgtacgacatcgaaccggcatggccgtttcccgtgccggtgggattgccggaccaagcatttttggaaaccaatgcgattgcagtgcatgacaacaacaatgagatacggcaatgggcaagcaagaatggttgcgaaatcataaccaagcatcgcaccataggcacctctttcgagttgatctccaaagtcgtcgttcctgacgaatcaatagccatgcgtgtggttggtcgtacgctggcggcggaatatcgcgaagcgcaccgccgcatagcatgtctggttgctgcttgtgacgttgctccggaaacaatcgaatcggccgctcgcatgacaggccatgaacagcctgacgacttcgatctgcttgtcagcgcagttcgatatttcaggcatcatgacgtgaccggtatgacgccgcgacagattccactgacaggattcagcggcaaatggctgaatgagtcaaaaaccaatcgtcgtaaggccatttgccgactgctcggtgtcgaaacgttgggtctgtcaaaacggccgaccgaactgcggttccgttatctcgatccggtccgcgacgatgctgagctcgaacgcatcatatggtgtccgtgggaaggcgaagcgttatccggcattaaatatgctgtcatcgttgagagcaaagacacgtatcagactatgccgccgattgcgcagggcatctgcatatggggttctggtcgcgctgtaagcgatgctgtacctgcggttcctgcactgcgtgacatgcgtatcgtgtattggggtgatatggatgcggatggactggaaatactttcgacattacgtgaatcaggtatcgaatgcgactccatcctgatggattgcgatgcatacgatcggtaccacagatttggtaccgatcgtactgaacgcagcgcgaagattgctatgcgggagcctaagccgacgcccggccttcaatcggcggagcgacgtctttatgaacgactgtgtgctgacaaaacaatcgcttatcggcgtatcgaacaggaacgcattcccatgcgtgatgcagttgacgaattacgcaagcttggcatccccgtggagtccattgaaaatcaggatttgccgatttaggctgagtgattggggatgttgccaagagctagaacggcttagctttttctcgtctcacattatgccttccgattaataatgcaacggcattgcatagctgcaaggtccggcactgctatccgatactatcgaactgttgttttgcgttgcgcgagaagggacaaacatggcaaccgcttggggtgacgagagtgtgcggaaaaccggagttccctcgcctatgtacttgatgggcgcatgcgtatgtgatgatacggaaaccgaaacaaggcaaagattggcgttgcttaagcccaaaggagcaaggaaattgcactggcgagacatgcggccatcattgcgtggcaaagtcgttgatgccatggctgcaatggacattgatcatgtcattgtggctgcggtaccaatgagccagtggaataccgccgaacgcgctcgccgtaaatgtttggaacgtcttctgcctctgctggaaacagaatacaacgtggacacgcttgtgcttgaacggcgcgagatttcacaggacaggaacgatatccgtttcatcgatggattgagaagccgcagatttatcgggccaattcgtgtcgaactctgtgcaggggagactgatgcaaggctatggctccctgatcagctgctaggagcgtacggtgatgcccaggccggtactggaagatacgatgaattcctcggccatgttcgaacagtgttcatcgacagtgattgatgtcctaaaaccgtgtatacttcatggtaagccaaccccgctggggaaatggaagtgagagccggacgccccgagtatcttgggggccggctcttgcgtttcggtccactgatggtccggaattttgcatactatggttcggttttccggcctgacacgccatcgaacaagcgttcgaatttggtcgtgtgttcgggtatccttgggacagatttggcgcgcgcataaccgtgcgcgcgggaacggtgagatggaaggtggggcgtggctgtggcggcaacgcggactggcgcaaggcgcgcaacaagcgcaacgggcgcgaaaaccggcaagggcaagaacggtgaggtcatcgtcgaaaaggtgatgaccagcgactccttcctgagccgggagatcaaaaaggcgccgctgatcgaacacgatggttcgctggtagctgatatctcgcacatcccgaacgatctcaagatcacgattcagggtgcgcgcgaacacaacctcaagaatgtcgacctggcgattccgcgcaatcgcatggtcgtgttcacaggcctgtccggttcgggcaaatcctcgctcgcgtttgacaccctgttcgccgaaggccagcgacgctacgtcgaatccctatccgcctacgcccgccagttcctgggtcagatggacaagcccgacgttgacttcatcgagggcctgagcccggccgtctccatcgaccagaagaccaccaaccgcaacccgcgttctaccgtcggcaccatcaccgaaatctacgattacctgcgactgctcttcgcccgcaccggcatccctcactgccctgaatgcggcgagcccgtcgcctcccagaccccgcagcagatcgtcgacacactgctcggctacccggagcgcacgcgattccagattctcgcgcccgtggtcaagggccgcaagggcgagttcgtggatatgatcgagctgctgcgctccgacggctacgcccgcgcgctcatcgacggcgagatgacgcagctgtccgacgacatcaaactcaccaagcagaagaagcacaccatcgaggtcgtggtcgaccgactcgtggtcaaggacggcatccgccaacgcctgaccgactcggtggaaaccgccctcaagctcgccaacggcagcatcgtcatcgacttcgtggacgaggaggaaggcagcccggcccgccgccagccgttctccgaacaccgcagctgcccgaacgggcacacgctcgaactcgacgaggtcgagccgcgcaccttctccttcaacgccccctacggtgcctgccccgcctgcaccggtctcggcttcaaactggaaatcgacccggatctcatcatctccgacccggacaagtcactggccgacggcgtcatcgaaccgtggagcggcaccaagatgacctcccagtactacggccacatcctcgaaggtctggccaaggaaatgggcttctccatgaagaccccttggaagggcctgccggacgacgtcaagcacgacatcctctacggccacgacttcaaggtcaacgtctcctaccgcaatcgctggggacgcctgcgcgaatactccaccggcttcgaaggcgtgatccgcacgctcatgcgacgccacgacgaaaccgattcgcagtccatgcgcgaatactacgagtcgtacatgcgcgaagtgccctgccaggtctgccacggacgccgtctgaagcccgaagtgctcgctgtcactgtggacggaaaatccatcttcgacgtgtgcgacatgcccgtcgtacgcgaactcgcctggatcaacggcctgaaactcgaaggctcggcacagctgatcgccggcgaagtgctcaaggagatcaaggcccgactcggcttcctgaacgacgtcggcctcgactacctgaccctctcgcgcgcggccgccaccctgtccggcggagaagcgcagcgcatccgactcgccacgcagatcggctccggtctggtcggcgtcatgtacgtgctcgacgagccgtccatcggcctgcaccagcgtgacaacgaacgcctcatcgaaaccctgcaccacctgcgcgatctcggcaacacgctgattgtcgtcgaacacgacgaggacacgatacgccgcgccgactgggtggtcgacatcggccccggcgccggcgaacacggcggcgaagtcatctactccggccccgccaagcacctcatagaagccaagcgctccatcaccggcgactacatcgcccaccggcgagagatcgccgtgcccgccaagcgccgcaagatccacaagacccaggtgctcaaagtcgtgggtgcccgcgagaacaacctcaagaacatcgacgtgagcttcccgctcggcgtgctcaccgtggtcaccggcgtctccggctccggcaaatcctcgctggtcaacacgatcctctacccggtgctcgccgacaagctcaacggtgcacgcatcgtacccggccgccacacgcgcgtggaaggcgtggaccaggtgcgcaaggtgatccacgtcgaccagaacccgatcggccgcacgccgcgatccaaccccgccacctacaccggtgtgtgggacaagatccgcaccctgttcgccaagactcccgaagcccaggtgcgcggctacggccccggccgcttcagtttcaacgtcaaaggcggccgatgtgaggcctgccacggtgacggcacgctgaagatcgaaatgaacttcctgcccgacgtctacgtggactgcgaggtctgtcacggcaaacgatacaaccgcgagaccctcgaagtcacgtacaacggtaagaccgtggccgacatcctcaacatgcccatcgaggaggccgccgacttcttcaaggcgtacaccggcatctcccgatacctgaagaccctcgtggacgtcggcctcggctacatccgacttggccagcccgcacccaccctgtccggcggcgaatcgcagcgcgtcaagcttgccaccgagctgcagcgccgatccgacggcaaaaccgtgtacatcctcgacgagccgaccaccggcctgcacttcgaagacgtgaacaagctgctcaaggtgctgcagtccctggtggacaagggcaatacggtcatcgtcatcgaacataatctggatgtgatcaaggaggccgactggctgatcgatctcggtccggagggcggcgacggaggcggcaccatcgtcacgcagggcacgcccgaacaggttgccgaatgcgaagcctcatggaccggcaagttcctgaaacccatgctttagccttccattgcagctgacctcgggtgggttggggtgtgtgttgctggacacgctccgggccgctcaggccaagtctttacggtccagcaacacacaccccaacccacccaatccctgatgattggcttaatagcgaggaggattatgacgaacgatattgagcggcatagtccggatgagtggcggaagactgcggcggcgttaatgtcggaaagcgtagctgtgggtgccggggaaacgacggcgaaggtgaatgcgaatggggcacctttgctgggggattctcgcgacctgttccgacccaagacctcggatattcccgccaaacccggtgtgtacaaatggcgcgacggggaagggcgcgtcatttatgtgggcaaggcaaagaacctgcgcaacaggctcaccaattatttccagccgctgtatctgctgcatccgcgcacgcagaccatggtgctgaccgcacgcagtctggagtggacggtcgtcgccaccgaactggaatcactgacgttggaatacacgtggatcaaggaattcgacccacggttcaacgtgcagttccgcgacgacaagacctatccgtatctcgcggtcagcacgggggagcgaattccgcgcgtgtgggtcacgcggtcgcgcaaacggcgggatacccggtatttcggcccctatgccaaagtgtgggaattgcggcacagtcttgaccggttgctgcgcacgttcccggtacgcacctgcaccaccaacgtgttccataaggcgcaactgaccggacggccatgcctgttcgcttccatcggcaaatgctccgcaccctgcgtgaaccgcattgaagcggacgaacaccggaggctgtgcgaacagctggtcggcgtgatgaccggacgactcggacggccatacatcgcccagttgacccgcgacatgaaagaggccagcgccgaactcgaattcgagaaagccgcccgactgcgcgaccagatccaaatgctggaaaccgtggtgcaacagaacgccgtcgtcttcgaccaggatgtggacgcggacgtgttcggcttcgccagcgacgagctcgaagcctccgtgcacgctttttatgtgcgcgccggctcgattcgcggcgaacgcaactggagcgtcgaacgagttgaggacatcgatgacgccgacttgatggccgaccttctggtgcaggtgtattcggacgccgccggggacaatcacccccagtcggccgcgaccatctccactaatcgcgaggccatcggctccacgcaaaccatcacggccacggacgctgtggcacgcgcccaggccacccgagaacgcaacacccgtcaggagaccaccgggcgcgcggacctgctggcacccatcgcaccggtaccgcgcgaaatcatcgtgcccgtcgaaccggcccgccgtgaggaactcgaaggctggctgaccaatctgcgcgggggagcggtgaccatccgtgtggcctcgcgaggcgacaagaagcagcttatggaccgcgccaacgagaacgccagccaagcactgcaacgcagcaagatgagccgcatctccgacatgggcgcacgcacccaggccatgaacgatgtggccaaggcattgggactcgcggaagccccgctgcgcatcgaatgctacgacatttcgaacactgtgggcggtgccttccaggtggcctccatggtggtgttcgaagacgcggtcgccaagaaatccgaataccgacgcttcgccatccgaggcaaggacggcaaaggcgcggtggatgatctgtccgcgctttacgagacgctcacccgccgcttcaagcacggcaacatcgccggcgactccggcgaaagcatcgacgcggaacagcgtgtggcctcggccgccggcaagatgaccactgccgtggcggcggagacaatcgctgcgaacggtaacgacaatggtgagggcggttccgacatcagtggcaaggggcacgcggtgccggtcggagtgcagaacgatgcgcgggagtccccgcccgacatcgtccagcagaacacaaaccggcatcactttgcctacaagccgaacctggtggtggtcgatggcggcaagccgcaggtcatggccgccgccaaggcgcttgaggactgtggcgtgaacgacgtggccgtctgcggactggccaaacgcttggaagaggtgtgggtgccggacgacgactatccgatcatcctcaaacgccagtccgaaggcatgtatctgctgcagcgtgtacgcgacgaatcccaccgcttcgccatcacctaccaccgccagcagcggcgcaaaggcgccctgcgcagcgcgctcgacgagattcccggcatcggcgaaagctaccagaagcggctgctcaaccacttcggctcggtcaaagccatgcgcgaagccagtgtcgaggacttcgagaaggtcaaaggcatcggccacgccaaagccgaagcgctgtacaacgcgctgcacgagcagtgagccggcccggtccagcagcccagagtaaattttcggttgcggggcctgtggttgacatattcgaagcaaagtgtcggctagcatgggaacagacatcaaggaggggatatggccaatcatcgttgcgctgtactcggcaaacccgtcgcacactcattgtcacccgtgcttcacaacgcggcctaccgttcgctgaaactcgacgattggctgtacgacaagcacgaggtgggggaagacgacctcgacgctttcctcaaaggccttgactcgacgtgggctggcctgagcctgaccatgccgttgaagaagaccatccaaccgtacggtgttccggaaaatttgtgggccaaggaactgaaggtggcgaataccgcggtattcgactggagcgtggctgccgatgatcccgcttggccgaacggcaagccgggcatcaagctatacaacaccgatgtcatcggcatccaactcgccttcgaccatgccaatcgcgaactcggcgaacaccacaccgcgtcgagaagcggcaccgcgctgatcatcggcaatggcaacaccgccacttcggcgttggccgcatgctgcatgatgcccgaaatcggccatatcgtcgtcgccgcccgtcaccccggaaaaaacaccgggcttaaaccagtggccgaaaagttcgtcaacgtgcataacccgtacaacgaaatcgaattaggcgacgatcaggccctgcttgaggcagcccgcaacgccacctatgtcatcaacacgattcccggacacgcggccgacaacgtcgcggatgccctcgccgatgccggaaccgagccattctccggactgctgttggacgtgatctacgatccacgccccaccaagctcatggaagcctggcgcgctcatggcggtcacgccatcggcggcgaagaaatgctgctgtaccaagctctcgtacaggtattgctgatgaccggtatctgggatgacgacccgcccagcgatgccgaccagcgtctgcaggacaccaccaccgaagacgaccagctggagatcgcgatgcgcaaagctcttgaggaggcgctgtaatgaatcaacagacaacgaaccgcgataccggcgaggcggccgccacgaatgcgccggcgaattccgcgacatccacatcgactccggacaaccagccgaccccgcttgatgccttcgaagtgctgctcatcaccggtatgtccggcgcaggccgctctcatgccgctgactgcgtggaagacatgggatggtatgtggtcgacaacctgcctcccaaactgcttatcccgcttgtcgacatgatgaccacctccggttccggatcggagtcaggcgtccacaagcttgccgccgtcatcgacgtgcgctccagctatttcgacgagctggccgccgtgctcggccatctggatgatctcggcgtcaaaacccgtattctgttcctcgacgccagcaacgaagtgctcatcaagcgctatgaatccgtgcgccgcccgcacccgctgcagcacggcaaccgactgatcgacggcatccttgaggaacgtcacctgctggaagacctcaaggaacgagccgactgggtcatcgacaccagctccctgagcatccaccagctgtccaccaaactctacgaggcgatgctcggctccggccccaccaccgtggcagtacacatcttcagcttcggcttcaaatacggtatgcccatcgacgccgatttcgtggccgacgtgcgttttctgcccaacccgttctgggtgcccagcctgcgcgagcttaccgggcacgacaagccggtcgccgactacgtgctttccagcaagggagccaaggaatttctcgacgcttatgagaaagctatcgagattgcgttggaaggatacgcccaggaagacaagcactacgtaaccatcgccgtcggctgcaccggtggtcagcaccggtcggtggcgatgagcgaagagctggctcgccgcttacgcgcacatgggctcaacgtaaccgtttccgcgagagaacagcacaagcgtcactcatcgtaagcaggcgtcgagcggtcatcgggcaagcgttcggtgaccacactgcgagaaagcagagcccataatacgtatcaaacgggttcgcttgtccaccagattaggtatcacagaaagccgatggcttccgaccgtgtgacagcagataacggcacgaagcgcctgaagcattgagaagaacgggactgtaggaggtagatcttggctcttctggacgatgtcaaaagcgagttggcagcctttgaaggcgattcgccagccgcgatcaaggcccaagctgcggccatgatccgttttggcggcggtcttcgaccggtacagaatacatacgttatccaagccgtattcacctcgcttgacgttgcagaatggctgaagaacacgttgaggaacacgttcgggcacgaagccgaggtcaatcacctcacacgtcagaccccgaacggccctgtcgagacctacgtggtgctcgtcacccgcaacgtagtggccttggctttgcagaccggactggtcgaccgccgcaagcagcaggtccgtggactgccgtctgaagtggtcaacggatccatcgcccaaatcaaagcggcatggcgcggcgccttcatggcccgtggcttcctgtccgatcccggtaaggccagcttcctggaaatcgcttgccccacggaagaggccgccatggccctgtgtggcgtggcccgtcgtctaggcatccaggccaagcatcgcacgctgcgtagctccgagcgcgtgacactcaaggatcccgacgccatcgaacgcatgctcaagctcatgggcgccacccgttcggctcgcgaatggaccggcaagcgttccgatggcgaggcccgcggcaaggccaaccgtctggccaacttcgatgacgccaatatgcgccgttccgccaaggccgccgccgaagccagcgaaaaagtgcagcatgctttcgaagtactcggcgataacattccggacaacctccgtcaggccggccagctgcgcatcgatcacgtggacaagagcctcgaggagctcggcaagatcgccgaaccgcaaatcaccaaggatgcgattgccggccgaattcgccgactgcttcaacttgccgagaagacggagaaggctcgcgcagccgaaggcaagtaacccgacaatccgatttgccgtgcctattcggcaaaacgcgacaacgatgtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgctcggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaatccattttctagctcccctccttgaggggagctacgttttttttagaagggaaacatatggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatcttggctgctcatacgtcatcgtcggccactccgaacgccgcaaataccatcctgaagatgacgccaatatcgtcgatcaggtacgtgccgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacccgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaacgcggcggaactcatttcccagcccgacgttgacggcttcctgatcggaggggcggccctggacgttgaggaactcgccaaaatcgctcgactggcactgaaatccacgaaatcacggaactaataccacggttttcccgtgtgtgcgctatgctggtcaacagtccaatcaatccggaggtaccctgtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtagccttgatcatcggcctcgacatgatgaccaagttcaacctcggctgatcggcttgcacgccatatagacttgtcgctcgcgacccatgaccgttaccgtcggtcatgggtcgtatgcgttctatcgagtattacgaaaggacatcaccatggtcactatgaaccgcaacaaagtcgttatcgtcggcaccggccgggtcggtgccaccgccgccttcggcatcgtcacgcacggcctgtgcaatgagcttgtgctcatcgactgttccgccgccaaggccctgggggaggcccgcgacctcgatgatggcagcgaattccaggaccgccacgtcaaggtgcgcgccggcgactacgccgactgcaaggatgcggacatcgtcgtcatcaccgtgggccgcaagccgccggccaactccaaccgcatggccgaactcggcttcaccgtgggtcttgtgggcgaagtggtcgacaacgtcatggcctccggttttgacggcgtgatcgtcatggtctccaacccggtcgacgtgatggcttggtatgcctggaaacgttccggtctgcctcgcacccaggtgctcggtaccggcaccgcgctcgacacctcgcgtctcaagaccatcatcggcgaagagaccggccttgacccgcgcaacgtgggcggcttcgtgatgggcgagcacggcgactcccagttcaccgcatggtccaccgtctcgctcggcggcaagccattcgcccgcttcctggccgacaaccaagaccgtttcgcctccgtgtccaccaccgaaatcgaagagaagacccgcacccgtggcaatgagatcgtcgcggccaagggcggcaccaacttcggcatcgcctccaccgtggccggcatcgtacagaccatcctgtgggacgaacgccgcatcgtgcccgtctccaccctgctggacggcgaatacggcgaacatgacgtgttcctcggcgtccccactgaactgcgcgccaatggtgccaacgagatcgtcgaactcgatctgagcgaggacgagcgggccaaactgcaccattccgccgaactcgtgcgtgaacactgtgaggggctgctgtgattctcgacgccatcacgccgaaacaaccccgactgctggtcgccgacctcgacggcacgttgctgcacgacgccgaggtattcgaggaccggttcattacccagcgcagcatcgacaccatcaaccgcgcgcacgatgccggaatgcaattcgccatcgccaccgcgcggccggtgagtaccggtctccagttcgccgaaaaactgccggtggacgccgtaatctatctgaacggcgccctcatcgatttcgacccggcccactccgacttcgacctgctcacctcaggtgccacgccggccgatgagaaccatttgatcaagattggcttctcctcacggcgtgcctgcgaagtctgtctgttcctgctcgatcgcatgcccggcctgaagctcggcatcgtgatgaacgacgtgcgctacaccaacttcgatgtgcgcgtgtattggaaaactcaggccttccaatacacgaacttccacgacgtgcccgaaggcgtggcggacaaaatcaccatcttccccgaacctgaacagtggaacgagctgcgtgcgctgattccgccggacttcgacatctccatcagcgaaggcgtgatgtggatgctcatgaacccgcaggccaacaaggagcacgcgctgcacctgctgtgcgagcgactggacgtgccgcttgaacagacagccgccttcggcgacgacctcatcgatatcaacatgatgagcgaatccggccggggcgtggccgtggccaacgcgaaccccaaggtgttgtccgtcgccgacgagatctgcccgtccaacaacgaggacggcgtcgcccaatggattgaagcgcagttgggttgaaccggtcgagactcgagaacacgccaaaattgaacttgtgttgaaccgggggtatgctttgaaccgttgttcaaaagataaattgaactcccggttggaggcataaggatatgagcgtatcggtgtttgcggaacgtctgcgcaatgcgatgaacagcaggggattgaagcaggtcgatttggtgcacgccgccgaacatcgtggcgtaaagatgggcaagagccacatcagccaatatgtggccggcaagaccatgccccgcgaggacgtgctcgaattcctggccagcgaactggacgtcgacacgaattggctgcgcggcgaggaatccaccacgcaattgaactcggacgcatccaacagcgtcacggacggcgaacacgccgccacaccgcttgccatgggtgccgccaagccccagacggacagcgagattcccgtgggccgccgccgcaccttcggcaaatcgcacaagctcgacaacgtgctctacgacgtgcgcggcccggtcgccgacgaggcgatgcgcatggaggccaacggcacccacatcctgaaattgaacatcggcaacccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctgctcgacaccggcgacgaagtgctcgtgccctccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgaacaccagctcatcatcttctccgacgaaatctacgatcgcctcgtcatggacggcctgcagcacatctccatcgcctcgatggccccggacctgttctgcgtgaccttctccggcctgtcgaaatcgcacatgatcgccggctaccgcatcggctggatgatcctgtccggcaacaagcgcattgccaaggactacatcgagggcctcaacatgctcgccaacatgcgcatgtgttcgaacgtgcccgcccagtccgtggtgcagaccgcgcttggcggccaccagagcgtcaatgactacatcgtgccgggcggccgcgtgcacgaccagcgcgacctcgtctacgacatgctcaaccagattcccggcatcaccgccgtcaagccgaaggccgcgttctacatcttcccgaagatcgacgtcaaacgcttcaacatccactcggacgagcagttcgcgctcgacctgctgcatgacaagcacatcctcatcagccacggcggcgcgttcaactggcatcgccccgaccacttccgcgtggtgtacctgccgcgcatgggcatgctgcgcgaaaccatgggggagatctccgacttcttcagctactactggcagagctgatccttggtacaggcgaacacgatcgatgccgggctgggcaccaaaccggtgccccgtctggccctgaccatgtcggtccccaccatcgtggcgcaggcggcgaacgcctcgtacacgatcatcgaccgactgttcatcgggcacatccccgaagtgggcaacgcggcgatgaccggcgtgggcatctgcttcccgattctgctggccgtcaccgccttcgcctcgctgatcggcgcaggcggcgcgccgcgcgcctccattgaacttgggcgcggcaacttcaagaaagccgaacgcatcctcggcaccagcgccgcgttcctcatcgccatagccctgaccctcaccgtgctgctgcagttggcgaaacggccgattctctacgccttcggcgccagcgatgcgaccatcgaatatgcggtcgacttcatcaccatctacctgatcggcaccgtattcgtgcaactcacgctcggactcaacaacttcatttcggcgcagggcaaaaccactgtggccatggtctccgtactcatcggcaccggcatatccatccttcttgaccccgtgttcattttcgtgttcggatggggcgtcaggggagcggccgccgcgaacgtgctcgcccaactggtctcgaccatatggatcgtactgttcctctcctccgggcgcagcgcgattcgcctgcggccgttgaacatccggttcgatcggatcatcatccccgtgctggcgctcggtctggcacccttcatcatgcagatcaccgaatgcctgatcaacgtggtgttcaacgtggggctgcaacgctacggcggcgacgattacgtcacgtcgatcaccatcatcacttcgctgatgcagatcgtgagcgtcctgaccagcggcttccagcaaggcatccagccgatcatcgggttcaacttcggtgcccggcatatggagcgcgtccgccaggcggtccgcatggccttcgtcacgcagatcgtctccgccacggcgctggtgtcggtactcgccacattccccggctttttcgcctcatggttcacctcggaacagactgtcatcgacatcgtgacccgcatgatgccgattttcgtctgcggctggggtatcttcggcatccagatgggcgcgcaatgcgcactcgtcggcatgggccaggccaaacagtcggtgttcttggccatcttccgcaagatcatcctgctcgtgccgctcgcgctgctgctgccgcactggatcggcgtcaacggcatcttcatcgccgaacccatctccgacgccacctccggcatcgtggccggcttcctgttctatgccacctaccgcaagattcggcgagatatggtctagactcctgattcaatggatgtgccgtctcatgcgttgcgaaacacgggacggatagaatgcctcgcaaaacgggtgcccgttgtttcgtgatatgaaggagattttatgccggtggtgtcgcgtcgtgcgcagccaacgtgatggccataatcgccgaaagcagggagaacaatggcagcacgcacaacacgacggtcagcagtcccaaagcttcacggccgatgcaataagcgacaagacctgcattgtcagttgccgatagcgctgggcagaaatcggtgtgtctaccagtgttgtagctgtaggtaaagaacgtgagacctgaccagaacagggcaacgggaacagagccgatggcgcgaaaagccctgtactcccgcaacggtcagacagagaatcgcgacaacactcagcgcagtcaccgtcataaaccacagtggtgaggtgacgcagactccataatcgtcagttgcttggcccgagagatagtagggcattctgccaatcgccggacagttcggatgcagcatcatgccgccccaaatgcgctcatatagtggtgcgaacgatacaccggcaccgctgagcgtcgcaacaactgccatcaccgaccgaccgccagactccggcacagaccgggaagaactaccgtcgcggagcatcggcgataccaatggcaacaccgaggatagccgggaccacccagccgagctggtattgctgcaagggcagcatggccagcgtcgtgtccagccagccgatggagccgccgaagacggtgattaggctggagatgcagctggcgaaggagtcgatgcccaccagcagcacggtccagaagtagacatgcgggaatcgcgcgccgagcgacttgtgggtcagcgccagcagcaccagcacgatggcgatcggatacagtgcggacaacaccggcacggaaaccttgatgatcgcgcttagcccggcgttggacacgatgaaactgaacacggtgaagatgacctgccaggtgcggtagctcaacgttctccctgcaacggtctggaaccgagtgtggaagtaggtggcgcaggtaccgatcagtccggtgcatacgttgaggcaggcgatgacgaagacgataccgaggaacgcggtaccgaacgcgccgaacagggacgaggtgagattggtgagcacggtcgcgcccgtgtctttggcgggatcgatggtggcgatggcgccggacaccacgcccacgtagctcagtgcgccgtagatcacgatcagcagcacaccggtgccgagtccggcatacgcggtctccttctgcacttgcgattcgtcatcgacctgctgggtgcggatattcgcggaaatcacgatgccgaaatagagcgcggcgagcagatccatggtctggtagccgtcgaggaagccacgtgcaatctggtttgtggagtagtcgcccatcggtttggccggggtaccgataccgtggattaggcaggcgatgaacaggacggcaatcagcaccagcagcaacggtcccatgaatcggccgagcactttggagagtttttcgggatgctgggcgaacaggaacgccagtgtgaagaacacgagcgagtagatgagttgggccagccagccgtaggaggacggcacgaaaggcgccaccatcatttcgaacgaggtggtcgccgtacgcggaatcgcaaagcaggggccgatggtgagcatgatcgccaagccgaggaacagggcgaatttgggggagacccggccggcgagtttgtcgaagccaccggcgaaggtgaccgccagcacgccgagaatcggcaggccgaccgcggagacgatgaagccgatggccgccggtatggtcgcggaaccggcctgagctccgacaaacggcgggaagatcaggttgcccgctccgaagaacatcgaaaagaaggtaaaggtcatcaccaaccgctggcgtgcgacaagtttgttcattacggttcggccgttctctcatgtgctcgtactactgtagcaacaaacgtaagaagccccgaccggttggggtcggagcttctgtgagctaatcagttaatgcgcgaaatgcgcatcagctaataatctcaggcgttcacgcggtcgatgccggactggacgtcagccagcacggaatcccaggacttgatgaaggcggcgacaccgtcggcctccagcttgtcagtgacgtccttgaggttgatacccagctcagccagcttgttgatgacggcgtgggactcctcgtaggtgccctcgatggacggagcgccgttgccgtggtcggccagagcgttcagggtcttctccggcatggtgttgacgatgtgcttggcaacgagctcgtcaacgtacttgcagtcggagtaggcggcgttcttggtaccggtggaggcccacagcggacgctgaaccttggcacccttggcagccaggtcggcccaacgcggatcctcggcaaacttcttctcgaagagctcgtaagccaggcgagcgttggccacagcggccttgccctccagagccttggcctcgtcggagccgttggcttccagcagcttgtcgacagcggtgtccacgcgggagacgaagaaggaagcgacggagccgatgtgcttcaggtcgtggccgttggcgtcagcctgggcgatgccctcgatgaaggcgtcgatgacctgctcgtagcgctcgagcgagaagatcagggtgacgttgacggagatacccttggccagggtggcggtgatggccggcaggccttcgagggttgccggaatcttgatcatggcgttcggacggttgaccttctcccagagttccacagcctgcttggcggtgttctcggtgtcgtgggccagacgcgggtcgacctcgatggagacgcggccgtcgacgaagtcggtagcctcagcgatctcgcggaagatgtcggtggcgttgcgcacgtcggtggtggtgagctcgcggacagcggtctcaacgtcaaccttgccgagctccttgagctgagcgtcgtacgggccgacctggctcagggccttctggaagatggatgggttggtggtaacgccgaccacgttcttgttggcgatgaggtcctgcagggagccggactcaatgcgggagcgggacaggtcgtccagccagatggaaacgccgttgtcggacgtacgctgagttgcttcagtcatttattttctccttggattcaagccctaggctcccctctcctgggagaggggagctgtccgcaacgcggactgaggggagtgggctcaagcattgctcccctcagtcaagctttcgcctgacagctcccctcagggaggggagccaacaattattgaattattgcttagttgctcacttggcggcttcgacttcggcgatggaggccttggcggcttccaccacgtgctcggcggtgatgccgaggtcgatcatgttctgagcgccgtcaccctgcaggccgaactgctcgatggagacaggcttgccgtaggaaccgaggtacttgtaccacggcatggcaacgccggcctcgacggagacacgagccttgacagcggccggaagcacagcctccttgtactcggcgtcctgctcctcgaaccattccatggacggcacggacacgacgcgagccttgacgccctcgccggccagggtcttggcggcagccacagcccactggacctcggaaccggaagccatgaggatgacgtccggagtaccctcggtgtcgaccaggatgtaagcgcccttcttgacaccgtccttggccttggcagcggtctcggcaagaaccgggacaccctgacgggtcagaaccatggcgccaggcagggtgttcttcttctcgaagaagtaacggtaagcctcggcggtctcgaaggcatcggccgggcgaatgacctcaagctgaggaatcgcgcggaaggaagcaaggtgctcaaccggctggtgggtcgggccgtcctcgccgacggcgacggagtcgtgggaccagatgtacaggttcgggatctgcatgagggcggccagacgaacggcggaacgctcgtagtcggagaacatgaagaaggtgccgccgaacggacgggtgtgggaacccagcaggatgccgttggtgatgcagcccatggtgaactcgcgcacgccgaagtgcagctggcgaccgaactcgttgcagttcggccactgcttggtggcgcactcggccggggcgaaggtggcagcgcccttgaggtcggtcttgttggagccaccgaggtcggcggagccgccccagagttccggcatgacggcggcgatggcgttgagcacggagccggaggcgccacgagtggcgacacccttgccgacttcgaaggtggcctcaaggtcgtcaagggccttgtcgaagccttccggcagttcaccggccttcagacggtcgtacagggcggccttgtccgggttggccttgcgccaggcgtcgaacttctcgtcccaggccttgtgggcctccaggccgcgatcggcgaccttgcgggcgtgggccagggcttcttcgtcgacgtggaaggactcctccggatcgtagccgaggagtttcttgaggccggcgacggcctcggcgcccagcttggagccgtgggaggacgggtcgttggtcttgcccggggtcggccaggcgatcagggagtggaccttgatgagcttcggctggtccggggcggcggcttcggccttggcgatgacgtcggccagaccctcgatgtcctccttgtaggagccgtcgggctggatgaagctgaactcgtcggtgtaccagccgtaggcctggaagcgcttgagcacgtcctcggccagcaccaggttggtgtcgccttcgatctggatgcggttggcgtcgaagatcacggtcaggttgccgagcttctggttggcggccagggaagcggcctcgccggagatgccctcctcgatgtcgccttcaccacagatggcccaaatcttgtggtagaacggggaatcttccttcggggtctccgggtcaagcagaccgcgctggaaacgctcgccgtaggcaaagccgatggcggaggcgaagccctggcccagagggccggtggtcatttcgatgcccggggtcaggccgtactccgggtggcccggggtgcgggtggcagcgccgccacggaagttcttaaggtcgtccagggtcacgccgtagccggagaagtacagctggacgtactgggtgagggaggcatggccaccggaaaggatgaagcgatcgcggccttcccagttgggatcattcggatcgtgcttgatgaagtgctggtacagcgtgtaggcgacgggcgccagggagacgggggagccggggtggccggagcctgccttctcaaccgcgtcagccgaaaggaccttcgccatcttgatggcgcgctcgtcgagctcggtctccttgaattcggtcatggattactttccttccaattggtcgggccgcgtatccggcttgtgccgggcgcttgacgccctcacattgcgattaccatgctagcgtcggtttgcgacgttgcggtgcaattttggcgtgttttggtagtttgtgttctgttagcgttcacagtgaacattgctacgctgcaaacgaacgcattagcactcaagcctaaggagtgctaatacaatgttctaaggtgaagtgcgccacctgcacgtggcggagccaagaaagaggcaatatttctgggttcccgcgtgtcgcggcgtggcgaaccgaccgtcggggtacgccctgagtgaaccgtgactgatatgaatatgtatgcatatataaggaggcgcgcatgacgcaatcaagacgcatgctggtgctgcgcgccgtggtggaggattacatccgttctcaggagcccgtgggctccacttcgctgacgcgcgaccatgatctcggcgtcagttcggccaccatccgtaacgacatgtccgctctggaggatgaaggatatctgattcagccgcacacttcggccggtcgtgtgcccaccgaaaagggctatcgatactttgtggaccgacttgctaccgtggtgccgctcagcgaggcgcaacgccgcggcatcaacagcttcctgtccggatcggtgagtctcaaggacgcgctgcaacgttcggcacgactgctgtccgaaatcaccggtcaagtggccgtagtcgcctcgccatcgctggccaaggccacattgcggcacgtggagatggtgcccgttgccatgaccacgttgctcgccgtggtgattaccgacacaggccgcgtggcccagcacggcctgaccatcgcatccatgcccgccgtggacgagatcaaccggctctccaacaccgtcaacgagcaatgcgacgggctgtccctatcgaaatccgcggagaccgtgcgatccatcgccgccagcgccggctacgagtcggtgcgtggcgtggccgacgcgctggccgacgccttcgaatcgatggcattggacgaacgcgcgaacgaactgtacatgtccggcacctcgcacctggcccactcccggtccctggccgatctggccccgctcttcgacgcgctggaagaacaggtcgtgctgatgaagctcatgagcaacctgagcgaggagacgaatgcatccggcgtgggcgtggccatcggctccgaaatgcacacccccggactactgcatgcttccgtggtcagcagtggctatgggcgcagcggagcggcgggcgaaccggcggggaacgatcccgtaggcgaacccgaaaccgaatccgagacggagagccagacgaacgacacggaacccatcgccttcgttggctccatagggccgacccacatggactacgcggccactatggccgccgtcagggccgtagccagatatttgaccgccttcctctccgagggccggactcaagactgaccgccgtctgtggcacaatgacccgcagaccaaacgaacacaaaggatcaatcaagtggcagattattacgagacgctgggtgtggaacgcggcgccagtgacgacgagatcaagaaggcataccgcaagctcagccgtaagtaccaccccgacatcgcgggccctgagttcgaggacaagttcaaggaagtgaacaacgcctacgatgtgctgtccaatccggacaaacgccgtatgtatgattcgggagtcgacccgaacaacccgaacgccggtgccggcggcttctccggggcgggcttcggcgatatgagcgacgtgttctccacgttcttcggttccgcgttcggcggtggctcacagggcccggtgccgcgtacccagcccggccgcgatgccttggcctcggcgtccatcgatttgaagacggcggtgttcggcggcaccgcgcatgtcgagatcaatacgttctccctgtgccaggagtgcggtggctccggtgcccagggcggcgcacagccggtcacctgccccgactgccacggacagggattcatgcagaaggtcgtgcgcaccatgctcggccagatgatgacctccgccccctgtgaacgttgcgagggccacggtaccatcatccagaacccgtgccccagctgcatgggccacggccgtgtgcgcaccacgcgtaccgtgggcgttaccgtgcccgccggcatcaacgacaacgcgcgtctgcggttggccaaccagggcgaagtgggtgagggcggcggcgctgccggcgacctgtacatcgacatccgcatcaaggcggataagcagttcacccgcgatggcgacgacctgcactgctggattcaggtgccgatgagctgggccgtgcttggccacgatctgtccattgatacgttcgatggtgagaagaccgtgtccatcccggccggctgccagactgaggacacggtgacgcttaagggactgggcgtcacgaacatccgcaacaaggacgagcgcggcaacctcatcgcccacgtcaatgtgcttatccccaccaagctcaacgaaaccgagcgtggcctcatcgaacagttcgccgcctcgcacgattcaggcgccacgcacgtctcccaggcatcccgtccacaggccggtcaaaagaaaggtttcttcagcaagttgaaggacgcgctgagctgagagcgggttggaagatggccgctttgccttgcgggagtagggctgagcggctttttcgttttaaccggttttaacggtttttaacctgtttttacggaaaatgtgggcaaaatgtgggcagaaatcgagcccgcgaagccctctgccacaacgcgaaatcggccccgtccggcagcagtcaagctctgtgcgagctgtctgcgatgccggacggggccgaactatgtgtggtcatgcggcgcggtcgaggcgttgtttgatggcgctgacgccgatgagcgcgccggcgaggatgccgagcgcgttgatcatggagatcaacaagccgatgaccacgaggaacatgctggcatcgaccctcaccgactacaagaaaccggtcaagctgcccaagatcacggtggagctcgaccccatgctcaagaaacggttcaaggccgaggccgtgcgacgcggcaccaccatccgcgacatgctcacggcatggatcgaatgcgactgccctcccctcgacgcggcggacgcaagggccgaggcgaagcaagacggaagaaggagtggatgatgacggatgacatcgaggagcgggccgtgctggcccgtcgcgggatcatggaccattcggattgcgaggagtgcacggaggactggacgttcctgatgcgtcagggacgacgggagttcccgttgggattgcgcacggtgctcgcgtgcctcgcgttcgccgaacgcgagggcgcggtgcccgagctgccggcggattggtgggttagaatcaacaggaggtatcgatgacgacgatgcgcggcgaggggagctggctatggatgtgttcaaggcatggccgggaagggcggaaagcatcgtgatcagccaggagtcatacatggggtgcaccggcggcgtggccccgtggcgtcgtgacggcgacaaggggccgtcctactacgcggtgtgcccgctgtgcgacaatcccatccagatcgtcggtctgttccgccggcaggaggaaagccgtgcgcgccggccctacgggcggcaccaccggggcgacgtgccgggcctgtgccgctacgacgaggacgcctacctgcactgcccgtatgcggatccgaaccatcggacggacacccgagcgagacgtcatccgaaggaccagaccgggcgggccctgtatggtctcatgcgcggcgagttcgaccgggtgacgctggcgtgggaacggttctccggcatccatctggggccgggggccgcccgtgacatgcttcgcaaatggcgggacgaccagggatggcgctactacgacgcgacctacggcaatctgccgcagatgctgttcttcgcggccggcggacagaacctggtcaaacgctacatcgtgccgggcagtccgttgcacgaacggctgaaaggcgtgccgcgggtgagattcacgccgacgcgctcccggtacgtgcaggtggacaaggccgggccggggttccttactctggatttcctgctgtacgcccggcgcatcgaatgggacggacagcacatgaacgagacgttcaggctacgcggtctgctgggccgcgatgacgggcaacaggccttcgatgacctgaccctcgacgtcgatcaggactggctcccccacacagcggacgcccagcccggccgcgacgagcggctactcgacatcgcgcgggaaacactgcaatccgacgcgggtatcccggcagatcaataaagcgttatcaatgcaaggagaacaatgatgaacgagaacgacaagacggaaatcctcgaacccgtcgaaacacccgccgagaacatcacagagccaagcaaggatggaaggaagtgtccgaagtggctgccgcccctggtcgcggccgtctgcgcggtgattctgatcgcggccggcatcatcggctggaacgcttacagcggcgcgaagctcgccgaggccaaggaggcgtgcgtcaccgccgccgacaccgtgcgcaacaatgccaatgaatacaacgcgctgctcaacggcgatgccgccgatgccgccgccgtcaaggccgaacaggtcaaggactcgaagaccgtcgaatccttgggcaaggagctcaaggccatggcacccgaatacgagggctgcgtggccgaaaacgcgcaaggactggatgccgccgccgtgaagctcaatgaacaggccgactggtacgagacccacgagaagagcctgtcgaaggcggtgagggccgtcgtcgaatccaaggccgcgaagaggctggaaaccgcgaaaacgaatctgacggcgaagctggacgaggcgtcgaagctgctcgcggattcggacggcaaggtcgcggacaacgccacccgcgacgcattgtcgaacgccatcgacgcggcgaacgggctgaaggacgggaacgatccggcgaagatcgacggggcgcgcaaaacgctggaggatgccatcaatggcgtgaacgcgagcgtccaggcaaagacggacgcggatgcgcaagccgccgcagcggcagcagcggcagcccaggctcaggcgcaggcccaatccacctacagcggcgtctcctcctactccggcgacgcgtacgggcgcacggaaggctccacttccggctccaacacataccgtggcaccacatcgggcggcaccggctccggctccacgtccggctccggcccggccggcggctccgccccaaagccgaacctcaacggcgcttacggctgcggcaacagctgcaccggcaaggatgatggctattaccatcactgatcgatgaatggctgattatggctcgtatcgggaaaccggtacgggccttttccatggatttcgcaaaggaaacccatttccccgtgaacccgtgtccccgcactcccgtgtacccgtattgccgggaaatacttccggattttttgtagacgccatgctccgtggttcggcgtgtcgtctgtgaggcttgttggtggctgccgggccaaccggtggctacctcccgttattcctgcggtcggaagccccgccaccccttgaaaaaagaggcggcggggccatgaccggaacgattgagggaggggatgaacagacaaggttaacggaggttcatttaacggtggccttcgtcaacctcaagggcggggtcggcaagaacaccagcgccatcggcaccgccgaagcactcgcccgactgggccataccgtgacgctctgatgagctgagccgtgaagaaaacgccggaggcgtttttaggcgaaggcgaacgacagtgagcaaataaaatggcagctggaaagctgtccttaattgcgttcgagctgtcagccgtaaggctgaccgagggagagaccactcaatgcagagtggccccgtcaccgcttctaccaccaccaatattcggattttggtagttgaagaattcggattttcgcagttgaccaattcggactgttaatcggctcatcgtctgacccatcgcaatctcacacaaaatcgcattatcccacgccgaatcgagctcagcgaaactccgatttgccaggtcggcagaatgtggcataatgaacaagttgccattttggcagcatggataagtgtccgagcggtctaaggagcacgcctcgaaagcgtgtgaggtgaaagcctccgcgagttcgaatctcgccttatccgcctttagggttccgggtttgtcccggaaccctttttgtttttgatacgaacgtccgtattcgctcctgtgctgtatcgtatacggcgtgtcgggtggaaaatagcgaaaaggataacgttgtactcagcgggacttgcgtactaagtacaaccatcgtattatcgatatcaacagaagtacaaggttgtattaaatatccagaacgcacattcaccgctgattggcgatgccgcaaaacaggtgaaccaagaagatgggccgattgcttttggtatttagcacaacgttgtcttgcggtattgaagacaacgattaaaggagagcacatgtccgagcattcgcacgacaataaaccgggggagctggaggaatctcgactcgtcgtcgataatgactttgaagtagctccggtcaacgacagactgttcgggtcgttcgtggagcatctgggtcgctgcgtatacgacggcatctatgagccgggccaccccgaagccgatgaagacggtttccgcaaggacgtcatcgaactggtcaaggaactcggcgctaccacgattcgctatcctggcggcaatttcgtttccggctatcgctgggaggatggcgttggtcctcgtgatgagcggccgcgtcgcctggacttggcatggcattccaccgagaccaatcagtttggtctgcacgaaatggcgaaatggctggaaaaaaccggcggcaacgagctgatggaagccgtaaatctgggtacccgtggtcttgaagaggccctcgacctgttggaatacgcgaatattcccggcggcaccaagctctccgaggagcgtcgcgccaatggtgccgatcagccgttcggcatcaagatgtggtgcttgggcaatgagatggatggcccgtggcagaccggtcacaagtccgccgaggattacggcaccttggcggcctcggtggcggcaggtatgcgcgccatcgatccgaacgttgaactggtggtctgtggttcatccagccacgtgatggacaccttcggcaagtgggaagaaaccgtacttgagaagacgtttgacaacgtcaacttcgtctcctgccatgcgtactaccatccggaacttcagcctgatggcacccgtgacatgaagagcttccttgcctcgggcgtcgatatggacggtttcatcaacgatgtcgccgccgccatcgatgcaaccaaggcccggctgaagagcaagcacgacgtgttcatctcgttcgatgaatggaatgtctggtatctcaacgaagagccgagcaagaatccggaaggcatcggcaattggccggttgccccgcgcctgctcgaggatgtgtacagcgccgccgacgccgtggtgttcggtgatttgatgattaccctgctcaagaacgccgaccgcgtgcacgccgccagcctggcccagttggtcaacgtaattgcgccgattatgaccgaaccgggcggcccggcgtggcgtcagaccacgttctatccgttctcgctgaccgcaaagctcgccaagggcggcacggtgcttgaaccgaaactggcttccggaacgtatgaaaccgacaaatacggtgaagtgccgacgatcaattccgtagccgtgcgtggtgaggacggtacgatcagcgtgtttgtggtcaatcgctccatggaagcggccaatgactttgccatcaagctgccggaaggattcgcactttccgcggtcgaggcgcaaaccctgcacgaggatgatctgctggcaaaaaacacgctggaagaccagaaccgagtcgttctgcaccccaacaccaccatcacgtccgacgccgataccggcactgtgcgtgtgaccttgccgccggtctcctggaccgccgtgcacgtgaagtgattcgagtgacggtggcgcatgacagggcgcagtctcttatggttgctgtgccctgtacaaccaccaagcaatacccaaacaatcatcaacatgcccggattgcagaaagagaggttcggattcgccactaatgtaatgtggcataccagtcaaaggaagacaatgccgtcattcacatcgactggaacaattcgatacccaacaaaggaataaggagaaaagacgggtatgtaaaaagctaggttgaaagccggcggtcagaaagtcccttgttcggatggcgtgcgtgcgtttcttcaaccagaaagtttaacctctacgttcgatcgtcctgcagtattgtcagaaggatatttgcctaatggtgcatggggtccaacggaggaaagctccttggctgaattctgaggttgaggggtagatgattccgatatgaggaggagatgctcgacccgactgtgacttaccataataagaacataatgacgctgttgaaggtgtgtcatgtaataagcagaaatggattcgaacaatgggaaaccgcgtaactatcaaggacgtggcgcgtgaggcgaacgtctccatcaagacggtttccaatgtgctgaatgacactggcagtatgagaccggatacacgtcgccgtgtggaagaggtgatgcgtaagcttggatataccgtcaatatttcggcgcgtgcaatgcgatctggcggcacaaagcttattggactcaacatcttcgatttctcgcagccgttcgttccttttttcactgacaaggtcattgaatacgcaaaagaacgccattacggtgtagtcatcaacacatatggttccgacggtgaagggttggttgccagcgttgacgagtcctatcgtttaggggcggaaggatggattctgttcgtaatgtcgccgctcgcggatgaaggggccgttctggagcagccatatccgattgtaacgaccggagaccatctggcctacgggaaaagcgattggatcaccatgcccaacattgaatccatctccacggttgtaggaagatttttggatgaaggtgcccaaacggttgctctgatgggtgttcttcctgaactggtggatgaggcagtgctgcgtcgtcagacggaagggacccaggcgttacgcgcccaaggatatgtgaaggcatttgaagagcgcggattatcggtgaattggcggtatgtgattccggcagaaagcatgaatcagcgtgaaggtatgcgcgtgacaaaagctatgctagacaagctcccatgcccggatgttgtagtgtgtctcaatgatgccattgctttaggcgcaattcatgaattgcaacgatgtggtttgcatgtacctgacgatgtacaagtggtcggcttcgataacgtgccggaagccgagtactcggtgccggcgctgaccaccatcgatcctcatatcgatgattatgccaagcatgccgttgacatgcttatcgaccgcatcgaaggatactcaggcccggcccgtacgtacaccaccgatttcacattggtggaacgtgcctcaactcgacttgcccactagcatccaacaagttcgcatcggcttcgtgaggagtgtgtgtctactcgaacaatgcggcgtcagtcgctgggtagccaagttggaacgcggtgtaggcgtgcttggcggccagtgcggcgaggatgagcagcgtatcgctctcggtggaagatttcgattcggtcacggccttgatctgcgcgcgggcgcagtccatttcgatggcggcggcggtcggtacggtttggccgcttgccttgtcggcgatggtggtggggttggccagtagttggtcgatggcatagaccttttggcgggggtcgttttggccggaagaactggattgtgcgccggaatcatcaaaattgccgttcgccagcgcaaccaactgctgcccggcggtcttatgcatatcgctcaacgccaacgtagccccagcggtctgtcctcgtgcggccaagacctcgatagcgaatccggcgcgatcctcggccacggccatcgcatccaataccgatcgatcaacgttggcggacgtgacgccatcaagacgcgccggcgtcacctcaggcgcggactgcccgaatttatcggccagaaaagccagccattgcttggtctgcgcgtcacgtaacgttccctcggcaaaacgacccgaacaatacccggcaacgtcaatccaagccaggggagcggccagaccggtggcatactgctctaataacggcgtgccttcagccggatgggtggcgtagcccgccaacgtcatcgctttctcgcaaggggtcatttgagcttctgcctcggcccgtccggccagtcgcggcatcgaacacgccgaaagcgaacacagcatcgcgctcgcgcatagtacggatgccaagcgccgggtaaaccgtcctgaagagaagcgtgtctgcatggaaacatacactaatagctaactgtgactactcataggccatgcgccacataacttcataggaggtacggatcgatggaactggacctgacaggaatacacaagctcgccgccgagcaaggaatcgaccccgaaaccctggatgatgcgctggcagaggccctgcgcctcgcctacctcaagaccccgcacgccgccaagcacgcgcgcgtggagcttgacgaacgttccggcaacttcaccgtgtgggccgccgacgaaattccggtcgaacccaccgaagacaacccttaccccgttcccaagctgggcgaggaatacgatgacaccccgcgtgacttcggccgtctcgccgcagccaccgcacgccaggtcatcacccagctgttccgccgcgccgaagatgagaaggtattcggtgcgttctccggccagaagggcaagctcatcaccggcatcatccagcaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgcgaagtgccggaactggtctccggtgccgtgtccatcatggccatcgctcgtgaggccggcgcccgcaccaagatcgcggtcaaggccaacaccgatggcgtgaacccgaagggcgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtgcaggtgatcagcgagaagaacaagaccgccatcgccttcatccacgacgaccagctgtccttggccatcggcaaggaaggccagaacgcacgactggcagccaagctgaccggctggaagatcggcatcgaatccgccgaggcccatgccaagaaagtcgccgccgaaaaggccgcccaggctgcggccgaggctgctgctccggaagccgaataggccgccgggctcgaaggcgaatgatcttcagggcgcattatttcctgatacgagccgcgtcagcaatggcgcggctcgctgcgtctacgctatccagcgctatgagtatgcttgattggcgtatgtgggctggcgcagtgtgcgcgaaatcgcccacaccagagacgaggtaacacgatcatggtcgcacgatgagacagggtaggcttgccgtcatcaccaactgaccacgcccatgcacgcgcgtggtcacagaataggagtaattagtggcgaaaccacgcgtatacgaactggctaaggttttgaatgtcgatagcaaaaccgtgcttgagaagcttaaggacatgggagaattcgtcaagtccgcttcttctacgattgaaccgccggtagcccggcgtctgaaggcagagttcgccaaggacaacgccaagggcgattccaagcccgtgcagcagcgccgcccggccgcaccttcggccccggcttccacttcatcttccgcaccgactccggccgctcccgcacgtcaggcatcgcctgcctcggcacatcagcaggctccgactccgggtgcaccgacaccgcgtccgcagggcggcgcacgccccggcatgccgacccccggccgccacggtcagaacgacaaccgtgagaatggtcgcgataatcgcgaaggccgtgagaacggtcgtcagagtcgcccgaacgatcgccgtaacaacgatcgtcgtaacaaccagggccgtccgaacaatggccagccggttcagcatcagaacaaccgcggcaatgcttcggctccgcgcccgcacgctcagggcggcgccggtgccaatggcggcaatgccgcttcaaatgcgattccgcgcccgcacgctcagggcccgcgcccgggcaacaacccgttctcccgcaagcagggtatgcacaccccgacgccgggtgatattccgcgtccgcatccgatggctcgtccgactgctgataacggtcgtggcggtcgtccgggccgtcccggccaaggccaggggcagggccgcggcttccgtggcggtcgtccgggccaaggtggtcagggcggtccgcgtcccggccagtggggccacaaccgtccgggtcagggcggcggctcccagggtgccggtcagggcggcgcacgcggcggcttccgtgggggccaaggcggcggcaataacttccagggcggcggtgcaccgagcaacggtcccgcacgtggcggcggtcgcggcggtcgcggcggtgccgcaggcgcattcggacgtcagggcggcaagtcttcaaaggcccgtaagaaccgtctggcaaagcgccatgagtatgaggagctgaaagcaccgaccatcggcggcgttcgcatccccaacggcaacggccagaccatccgtctgcgtcagggcgcgtccctggccgatcttgcggagaagatcaacgtcaaccaggccgcgctggtcaccgtgctcttccacctgggtcagatggctaccgccacccagtccttggatgaggagaccttccagattctgggcgaagagatcggctggaacatccagctcgtctccgcagaagaggaagacaaggaactgctccagcagttcgacatcaaccttgacgaggaagaactgcaggatgacgaggatctcaagcctcgcccgccggtcgttaccgtcatgggccacgtcgaccacggtaagacacgactgctggataccatccgcaagaccaacgtcatcgcacgtgaggccggcggcattacccagcgcatcggcgcctaccaggtcaccgtgaaccttgaaggcgaaccgcgcaagatcaccttcctcgatacccctggccacgaggcgttcaccgccatgcgtgcccgtggtgccgagctcactgacgtcgcgatcctcgtggtcgccgccgacgatggtgtgatgccccagaccgttgaggccatcaaccacgctcaggccgccaaggtgccgatcgtcgtggccgtcaacaagatcgatgtgcccggtgccaacccggagaaggtccgcggccagctcaccgagttcggcttggtccctgaagagtatggtggcgacaccatgttcgtcgacatctccgccaagcagaacctgcacgtcgacaagctgctcgaagccgtgctgctcacggctgacgctgagctggacctccgcgccaaccccgacatggacgcccgtggtgccaccgtcgaagcccgactcgacaagggtcgtggtgccgtggccactgtgctggttcagcagggtacgctccacgtgggcgatgccatcgtggccggcacttcgtacggccgcgtgcgtgccatgctcgacgagaacggtcagccgatggaagcggccggtccgtccacacctgttcaggtgctgggcttgacctccgtgcccaccgccggtgacctcttcctggtcgcctccgatgatcgtgccgctcgccagattgccgagaagcgtcaggccaccgagcgtgccgcccagctggccaagcgtcgcaaggtcgtctccctcgaggacttcaagaagaagttcgccgagtccgagatcgacatgctcaatattgtcatcaagggcgattcgtccggttcggtcgaggcgctcgaggattccttgatgaagatcgaggtatccgacgaggtcggcatccaggtcatccaccgcggcgtcggtgcaatcacccagaatgatgtcaacctggccacggtcgacaaggccgttatcatcggtttcaacgtgcgtccgaaccgtcaggtcgcggacctcgccgagcgcgagggcgtggagatcaagtactactcggtcatctaccgtgcgatcgaagacatcgaggcatccctcaagggcatgctcaagccggaatacgaagaggtcgtcacctctcactccgagatccgcgagatcttccgctcctccaagttcggcaacatcgccggcgttatggtgcaggacggcgaggtcaagcgtggtacgaagtgccgtatcctgcgcaacggcgtggccacggtcaacgacctcgagatctcctcgctgcgtcgcttcaaggacgacgttcagtccgtcaaggaaggctacgaggctggtatcaacctcggcaccttcaacgacattgaactcggcgacatcatcgagaccttcgagatgcgggaagtcgagcgcaagtagtcattgttaagccccctctgacgagggggctgtcagccgcagactgactgggggagagacatggtagttccatgattttctctcccccagcctcactgcgttcggcagcccctcgtcagagggggctcaagtctagaaaaggaaattcctatggcaggaaccaacccgcgcgccgcacgtattgcggccttgattcagcgtgtcgtcgcctcctccattgagcgcgaactgcatgacaagcgactcgccagcatcaccgtcaccgaagttcgtgtgaccaacgatttgcagatcgccaaggtctactggacccagctcggccacgaaggccacgaggaaggcgaacgcaagcgcgcccagcaggcactcgatcaggccaagggccacctgcgttctctggtgggccacaaggctggcctgcgcctgactccgcagctccaattcgtgttcgatgaagtgcccggcgaggctcacgagatcgaagacatactcgccgtggccaagaagcgtgacgaagaactcgcccgcgcccgcgccaccgcccagtacgccggcgacgccgatccgtacaagcatgacgacgagcccagcgacgacttcgaagacgactctgacgaggagtagtgtgcttcatacaacacccagcggtctgctcatcatcgacaagccgcaaggcgtgaccagtttcgacgccgtcgccgccgtgcgcggcgcgttgcacatcaagaaggtcggtcacgccggcacccttgaccccatggccactggcacgctggtcatcgccttcggccacgccacgcgactgctcaacgccatcgtggcgcatgacaaaacctacgaggccaccatacgcctcggcctgcgcaccactaccgatgatgccgaaggcgaggcgcttgtcgatgatgaagcccgctcccgctggcaaacgctgtcagcgcagctgaccgagggcggccagagcggcgaaccaacggcgtcaccaactgcctcatggcaaaacctgctcactcgcaccatcgccaccaatttcaccggcgatatcgaacaagtacccaatacgttctccgccatcaaaatcaacggccagcgtgcctacgacttggctcgcgaaggcaaggatgtggaactcaaaccccgcccggtcaccatcagcgaattcaccgtgctggatatccgcagcggattcgtagcaggggagcaggccgctgaaccattgcgggaagacgcgaacacgggaacgattcccgcacttgatattgacgtgcgggtcagctgttcatcgggcacctatatccgcgcgctcgcccgcgacctcggcaatgaacttggcgtcggcggatacctgacccgtttgcgccgtacgcgagtcggccgattcgcgttgccggacgatgccagcggacttatcgctcctgaggcgatgcttgacacgcgaacccataccgtcaccgcacataccgatcagaagacgttcactaatcgggaagggcaaaccgtcacgcgcaacaagtgcgtattggacactcctgaaggtcttgccggtgacgagcgccgcaactggctgcttgaccatgcccttaccatggaacaggccgctcgaggtgcgatgccggcgcttgacatcactcctgaggaggccagcgaattacgcttcggccgccgtattgagcgtacaatcagcgagcccactgccgccattgtgccgcaaacgcatgatgtggcggcgattatcgagcgtgcaaacgctcatcaggccaagccggtcaccgtattccccctcgcgtaaagtagacgcggtgaaaagtgcagcttgatacaggccgcgcacaacaacgtctatattgcatgaataacatcgcacggataaaaggaacagcacactgatggatatcacgcacctgacccctgacgccgaaggttcgattgaatggccctcgttcagtaacgataagaaggccgtggtgacattgggcgcatttgatggcatgcacttgggtcatcaggcggtgatcaagcgtgtggtggaactcgcgcaccagcatgatgctttttccgtggtgattctgtttgatccgcgccccgcattcgtgcacggctgggtcatctcgcaccatggcgaagaacccgcggtgcagaacgtggatgccgaagccttgaccagtgtggatgatcgactgcaccgcatggaacagttcggcgtggaccacgtgctggtggtgcactacacgctggccttcgcagctatgtcatacattttcttccttggccgactcaccggcaagctgggtatgcgcacgttggtccttgggcaggatgccgccatgggcaagggtcgagaaggtgatgtgaagcatatcgccaatcttgccgccgccaccggtgtattcgaacttgatgtggtcgatgaccgtggcccgggtgaagtgcgtattccgcgcgatttcaagccggaagccccgagcgaatggggagagcccgtcgacccgctggccaatgccaccaaggccgagcgccgcgcatggagcaagaagaaccaggccaaggcaatgcgcgcatggagctccaccaatgtgcgctacctgctggctcatggccgaatccaggacgccaacgccattctgggtgctccgcactccatcgagggcgaagtggtgcacggtgaggagcgtggccgcaccatcggattccccaccgccaatcttggctccgacattgcaggctacattccggtcgacggcgtctatgccggttggctggtagatggtgaaaaccgttggcccgccgccatctccattggcaccaaacccaccttcagcgagaaaacagggctcaacgaacgtgtggtggaggcctactgcatcactgaagaatggatcgacctgtacgaccacaaggttcgcgtcgaattcgtcggcttcctgcgcccgcaggtcaagtttgatggccccgaccaactcgtcgacgaactcaagcgcaacgtcgaggagaccaagcgtcttaccgcctgaggcatatctcagggctatttacgcactcccaaggcgtctaatgcgtcggacaatgtgttggactccaccagctgaagtccctcgacatgcaccggcttgcgcagtggcggaatgaccgccgtggtgaagccgaggcgtgcggcctcgcgaaggcgatattccatacgcggtaccgggcgcacctgaccggtcagggaaatctcaccaatggcgcacgtggctcgcgcaatgggttttgacgtggcggcgctcgccagtgccgccactatcgccaagtcggaaccgggctccttggcctggcccccggcaatagtggagatatacaggtcgttggacagcaggttgagcttgctgtgacggtagagcaccgcgaccagcatggcgatacggctggggtccacgccattgaccgcacgacggggtgtgggcagcaccgacgtggtgaccagagcctgtacttcgataggcagactgcgatgcccatccaatgtgaacgtcacgcaggtgccttccacgggtgccgcgttggccgcatcagggccgtctccagacaggaacaatccggcgggatcggtgacctcttcgatgccttcaccgctcatgtcgaaacagccgacttcatcggtcgggccaaaacgattcttcaccgctcgcagcattctcagcgcagtctcgctgtcgccttcgaattggcagaccacatcgaccagatgctccaatgtgcgcgggcctgcaatcgaaccatccttggtcacatgaccaaccagaaatactggaatgtcaagtgtcttagcggtatctatcagcgcgcttgccacttcgcgcacctgagtcgaaccgccggaaatgccatcgacctcctgcgagacgatggtctgcgccgaatccacaatggccaaggccggcttgttctgttcgatcagccccaatactgtggacaggtcggtggtggaggccagtaacaagttcggctccaccgcattgatgcgggaagcgcgcaaacgaacctgcgcctgtgattcctcgccggaaatgtacagcacggtgttggcgtgtgttgatgatgcgttgccccgcatcggcaccgtgttcgatgcgttgccctgcgcccggcccgactgttgggcagaccgctgacctgcccctcggaacgtactgtctcccgccacaacgcgcgcgatattgccggccgtctgcaacagcaatgtcgacttgccgatacccggttcgcccgctatcagcgttactgaacccggcaccacgccaccgccgagcacacggtcgaattcggaaaacccggtaccgagccgctcgacgctttccgtgcccacttcggtaatcggacgggctgcagatctggcgttgttggcaaccgtaaccgactgcgtgcgtgatgttcggccgggagcggccgtgcgagagcctgccgccggccgagcctcgtgaaattcctcgaccgtgccccactgaccacactcggggcaacggccgtaccacttcggcccgttccaaccgcattcggaacatacatactgcacacttgatttcgccatggtctcaccctaacccaaacaccagcggacggtaaatttttaccgttcacaagagtttcacgcggcttgcgcacaacgactaaaattacggccgcctagcgtcacgcggctgtgagagaatcggggcatgactaatagtgagaactcctcgaccacgcaatcccatggcaagttgattgcagtggtggttgccgcagctgttgtgattatcctggcagtgctttcggcctttgtgtggccgggttgggccatccagaagaatgatggcacctccactaccacccaaaacagccagcagaaaaccgaatcatccgagccgaccaagccgaccatcgacgccacagctttgccggatgatgccagtgagctgttgaaggccatgccgggcagcgtgctgaattacgcgcgtaccaaggcggatgcctccacgacgtggaattccgcgtcgccgctcgaggagtacactctgacctactccactggtgatgccgccaaggatgtcacgctggtcgccgcgcagtggtcgtcggcggacaatgccaagacccagtacgatgcgttggtcgctgcgcagaccggcgatgagtcggcatccggcaacgtcaaggtttccggcaacgtcacgggcgcgtacgtggtgaaggccgatgcctccaacagcaagaacgccgttgccatctggcagaacgataccgtggtcttccaagctaccggcaccaaggaagcggtcgatcgcttctaccagaagttcccgatgtagcatctagtatcggctgtcagctgctgcacaaacttatgaacgttggggcatccacattgctgatgtggatgccccaactgcgttcagggcatatgcggactatcggcaacatactggttccctctgtctggcaacacgtgtattatggtgcgagttgcaacttttacgattaatcgaaatggaggcttcagatgggttctgtcatcaagaagcgccgcaagcggatgagcaagaagaagcaccgcaaactgctgcgtaagacccgccaccagcgtaagtagtcttacctgcaatcaaggcattagaaaccccgtgatcgttatggtcgcggggtttctcttttgcttggctctttgccttgttcgggcaacagtaaagcccgcacctgcgatgtgcagatgcgggcttggaaaagcttagtgatgtgagacgatcacttgttggcgttggtcatcacgcgcgggccgttcgggtcgccgacgatgaccttgtcgaccatgttgaggaacaggccgtgctccaccacgccgaccgtgttgatgaggtcttcggccagctcctgcgggtgatcgatgcgctccaggtgcaggtccaccacgaagttgttctcgtcggtgcgcacttccttgccgtcggcgtcaagacgaagcaccggcttgtagccgcgggcctcgaacttcttgatgacttggccggcaccgaacggaatgacctcgaccggcagcgggaacttgccgatggtgtccacaaccttggactcgtccacgatccacacgatctggttggagttggtggccacgatcttctcccacagcagagcagcgccgccgcccttgatgccgttgaagttcttgtcgacttcgtcggcgccgtcaatggtcacgtcgatgtggtccacgtcgtcgatgtccacgatcttgatgccgtagctctcggcctgggcctgcgtgcggcgagacgtggtcacgccagtgaactcaagaccttcctcctgatgacggcggccgagctcgtccaccaggaacttcacggtcgaaccagtgccgaggcctgcgatcatgccgttttcaacgagcttggcggcttcgatgccggccgccttcttcagcgcatcctgctgtgccttatccatggtttctcctttgccatccttgcctccgccgcacggatcaacggcgtgaagccttatctcctatcctaacgcgaatgagcgattttgtgtcatcgtgtccgattgcggtacatattcgtgtgtttgggtgtcagtgtcgtacgaatggtgcgttggtgatggtcaggttgccgtcgccgtccacatagccttcgatttcgatgctgcctttgatcggcatcggctgcccgttgaaatacgggctcgttttcggcgcgggggagaaggtcagcgtaccggataccgtcagcccgctgggctttgcgggggatacaggttgtgttgattgtacaggttgcgttgattgtgccgctaagtgtgacgaagacttggtctccggccttgcggcatccgtctgatccgtcgccgcagccggcttgcgcaaacttgccgcatccgctttgccgtccaataccaattgcacgtctggaggcacatcggtgccatgtgcgtattcggagcccagcagcgactgccagccttcaatcggtagatagccgtcgcgcgcacccgaacggcaatcgcccgcataggtgcgtgccagttcatcgaccagctcattgccttcgttgccggcgtgacctttgacccatcggaaatccaccggaccagggcgttgcgagatctcacggtcgatcgcctgaataagctctttgttcttcacaggctttttctgcgaatttttccagccgttcttcttccagcctttgacccacttggtcgagcaattgatggcgtactgcgaatccgattcgatgagcaatggctcagggcccgggtgcgctcgcaaagcttccagcactgcgcacagctcaccaatctgattggtgccgttggtcgcgccgcccgcatcataaccatggtcgtcgtgcttatggccgggcttgccgccggcgttctgctcatgatcggcccaggcccagcccattggcccgtttggattccctaatgcggacccatctgtggatactgtgatagtcatgttctccaccctaacgcaagctgtgcaatctcttgctgaagtggggttgcccagtgcgaggcaaaacaacgtagtgaagagtgtgaataacatcacacctattgactttgcttgaaaaacatgccatcgcgcgtgaataggtgagcgctcacaagaaaaacaagacacttcctctctgcgggtgaggccggcaacaatggcgcatccggtatctggaatgagaataagggactgtacaaaaccagtgacggcaacatcgaaatcctcaaaccagaggcggacagcgatggttcgacctccacggccgcatccaagggcaccatgcttatcgcaggcaactccaaaaccgtggcactcggtccaggcggcatggccttggctcccggcctgccgctcggtcttggctggttcatccgacgccgcttaggattggatgcctccgacattctggaccgtaagctcggcttgaagtaacggctggttcggacgtgattgctgtcacgtacggatcatgacgacagcgcgaaggtcctcatcggtttacgtcgatgaggaccttcgcgcgcattaggggagtctgttgcgggctgcgctacgcgggtcatgctgcgcgggcgtgctatgcgaacaaactacgcgaacaagtcgttcagtgcctcggcaatcgtcggatgcgtgaacaccatatcgcgcaacgtgctggccggcgcgtcaagatccatcgccaacttgacgatattgatcacctcgtgcgactcgacggaaagcagcatcgcacccagaatgcggccagtattgcgttccacaatcgccttcatcagaccatccggtcgccgcattacctgggccttcggcacagcggccaccggcaatcgcttgaccacataatccaatccagccgccttcgcctcgcgctcattcaatcccacgcgcgagtaaggcgtggcgaggaatgtgctcgacggcacatgcttgcggtccttcaccgtgtacggacggtcggaaccattgagctgcgaccacaccacgcgatagtcatccagcgaaatgtacgtgtgctgcgggccgccgttcacatcgcccagagcccaaatgtcggctgctgtggtgcgcagaagctcgtcgactttcacggcaccgcgttcggtgagctccacgccagccgcctcaagatgcagtccctcgacgttcggcgtacgtccggtggccaccagtaccgcgtcggtggtcaggcagaatcgggcttcagccggctcggcgaaccgcggctcgccatcgtctgatggtttcgtttgaacgtgtgacatcgtggcgtgatcggtcgggttgctagtggggctggtggttgttgtagtgtcggtggcgccggtggcaccggtgatatcggtatgagcgttcccggtgccggcgggggtggaatcgcaagcttgcgatgcgccgcgagtcatacccttcaccgcaacggacaacctgacgccgccgtcagcagcaggcgcgatggccttggtatccgcgttgaacaggaacttgacgccctgcgcttccaactgtgcgcgaatcgcggccgccacatccgcatcctcgcgcggcaggaactcggcattgtgctgcagcacggtaaccgccgtgccgaaatcggcaaacatcgaggcaaactcaagtccaatgaatcctgaaccgataatcaccagtcgctgcggcatatcgtcgagatccatcagtccagtgctggtgtagacgccgggcgtagtgcggataccgggaatatccggaatgcgcggcgtggcaccggtattgatgaagatcttgctggcggtcacggcgaccgggccctcagcggtggcgatttccacgctatgagggccggtgaagtgagcgcggccggtgattacggtgatgttgtcttggtcggcgagcttgtgatagttcttgtcgcgcagcatcgaagtgacgcggcgcttctccttgatagcagcctcgaacgctgcttcgcgggtttcgggagtactgttcgcgccatcccgccgcgcctgttcggcggacaaaatcagtgacttggacggcaagcatccgatattgatgcaggtgccgccgtacatgtcggcgcttgcctcggcgacgacgaccttgcggccggctgcactgagcttggcagccaaggttttgccgcccttgccgaatccaatgatcagggcgtcggtggtgatagtgggggaggtgttgggtgtgctgatggcattgggtgtgctgatggacatggttacttccttacgtattcgagtgataagagtgcgttgtgctgatgtgttgtgtgccgtgcggcgtctgttttcttctttgactgccgaagcgttatcgactgatgctggctaggggaaacgcgcgggattattagcctttgcgctcgctgaatatctgttcggtgatgtcgtggatggtggtgtgttcgagttgttcgaggcaagtgcggttgagcccggcatagatgtcgttcatcactgcgcccattgaagatgacaccagacagtcctcgtgtacgtcgcccggtgtccagttcactttcacaaaagtggtgccggtggcttccgctaccgcgcgcaaagtgatttcggcggcgggccgggccagagcgtacccgccttcagcaccctctttagtggcgatgagtccggctgaggcgagcggtcgcattactttgcgcacgcgcgccgcattggtacatatgttctcggccaggatctgactgggcaggtgtgtggcgcgatggtcaaggtagaccaatgcgtgcactgccagtgaatggtcgccgttcatgaaacgacctccttaccgagtcgatactgtaactatgatgtgtacagttatgatactgtaatcatatcagatacagttagtgtgtcaaatcggggttgaagaggtgggtgactatgtgtataagtgaggtgtccacatggttatccacaatgaatgtgcgtaagtgaagctaggaccacatacctcggatcggcttccgtttccgcacccactacccatatggtggtgtcatgaacaggatgaccgacggcatcaccaactatggagctctgccaggctctatatacgatcagcctccggaagaatcggaggcagtttttgttccgcccgaatttgcggggtcattttctactgactcgaaatacccgacttctcgcgactcgtcatcgccgaacagtggtgcacatgattctgcagcgacaccgaccatgagcgaaagcctcgcccagcgcaaacgcgacatggtcgcacgctgcactgaggaagcgaaacgggcgggcaagaagctgcttttcggcatgaccacttccctcgctctgcaatccgtaccgattcccgccgattgcgacctcgactcggccaagctgcacactgtatccagcgttaagagcaagcggtttcgtacacgccatgcaccactgcaaacgcatatttggaaacatgcggctaaagccgccaatgtggaaatgaaccaacacgtgtttgcgctggacctgtttcacgtatgggcccaacttgccccgtatgtttcttttgagtccctgattgtgctcggggatgccgtcatcgctgctacgagcaaacagccagtattggccaaggatcgtgatgctgctgcaatctatcaggatctggtgaagttcgtggagcgatttacccgattcagagggcgcccgtcctgcgttcgagcattgccgctgatatcacctggtgctgattcgcccaaagaatcagaagaacgactctctctggtagcgcatgggattccacagccggttgcgaactatgtggtgccggatgcggcttttgcatctggagctcccataacgttggacttagcgtggccagagttcaaggtcgctgttgaatatgatggcgatcatcatcgtacgagtaaggctcaatggcgccgtgaccaagagaaaaggggtgtgctggtcgggcggagatggctggtcttcgtcgccacggcggcaagtatcgctaacgaggacgctcgtgctgaattcgctttcaacgtggcgagggcgcttgcttcgcgcggtgccgtattcgagtttcatgtagttgccatgtctcttgaagagttgtcgcagagcctgctgtgaccataatgtccgaaacggactgatgtaaaggcaatatttgtacgacctgttgttgtggtgtgtgcttgatattgcatgccgttcgattgcgatgcctcgtagtgatggatttcgtgaatgactagtgttcgattgtggagggaaatgtgtcatagtggtcgattgggggtgttgtcggtgcattgagcgtggatttgcgccaatgggtgtgggacgctacgcgtgttttgccgatttttgcgtggcgtcccacggcccctcgggtaatggctgtgacgggtgtggcaggaatggcgtctttccggggtttccagtttgagtgtgtgggatggggaaaatgtaaaacgattgacttagctgttgtcccacgcttttgtgggatggcaactctggaatgggcaaattcgtcgtggcgtcccacaacgatgttaaaactcgaccatgatgcaagccgaccgaacgcttcggtggtcatctggccgctgtgaccccacaatgatgatgggaaactcggtcataatgtaggcaggcgaacgtttcgcggccatatggccgtcctgccctgcagtgatgttgagaaaatgcggtcacggtgcatgaggagaaccgttgacctgcgtgtttcagtggtcgcgaactgcatatgcgctaaaaaaagctctgcagtggattgcatgaatccaatgcagagccttattagttgcggtgaacgcgactaacgcagcgatttcactcgctcagggccttgtcgaccacgacggtggcctcgtcgagtaccttgtccagagcctcgggggagacgaaggactcggcgtacaccttgtagatgttctcggtgccggaggggcgggcggcgaaccagttgtccttggtggtgaccttcagaccgccgatcttggcgtggttgcccggtgcctcggtcagcttggcggtgatgtcttcgccagccagggtggaggcggtcacgtcgtcgccggacagtgccgcgaacttggccttctgctccagtgtggtcggggtgtcgacgcgcttgtaccaagactcgccgaagcgctcgacctgctcctggtgaagctgggccgggttcttgccggtcttggcagtgatctcggcggccagcaggtcggggatcagaccatccttatcggtggtccacacgcggccatccttgcgcaggaagctcatgccggagctctcctcgccgccgaaggcgacttcgccgctgaacagcgggtccacgaaccacttgaagcccaccggcacttcgatgaccttcgcgttgatcgatgcggccacgcggtcgatcagggaagaggagaccagcgtcttgcccacggctgcgccctcaggccagcccggacggttgccgccgaacaggtactccacgcacacggcgatgtagtggttcgggttcatcacgccccagttcgggcagacgatgccgtgacggtcggcgtccgggtcggtgccgccgaccagatcgtacttgtcccaagcgccggcgttgagctcgtcgaccaggcccttcatggcgtacggggaagacgggtccatgcggatcttgccgtcgtggtcgatggtcatgaagcgccaggtcgggtcgacctcaggacgcaccacgccgatgttcaggccgtacttctcgttgatgagcggccagtagttcacggaagcgccgccgagcggatcgatgcccagacgcacgccggagttgcggatcacgtcgaagtcgatgacgttctccaggtcgtccacgtagtgctcgcggaagtcgaagccctcgacgtactcggacttgatggcctcctcgtagggcacacgcttgatggacttgaagtcgccgagcagctcgttggcgcgagcggcgatggcattggtggtctcggccggagccgggccgccggtgacggggtcgtacttgaagccaccgtcggtgggcgggttgtgggacggcgtgacgacgatgccgtcggcgaggccctcgccctcgaagcgctgggtgccgtcggccgcacggttgtgggtcaggatggcctgggagaccaccggggtgggcacgaagtcgtcacgggaatcgacgcgtacgtgcacgccgttggcgacgagcacctcgatggcggtcttcttggccgggccggacagcgcgtgggtgtcggagccgaggtacagcgggccggtgacgccggccttcttgcggtattcggcgatggcctgggagatggcgatgatgtgggcctcgttgaacgaggtcttcagggacgatccgcggtgaccggaggtgccgaagatgacacgctgctcggggacttcgggatcggggacgaggtcatagtacttgccgataacctcatcgacattaatcagatctgctggggtggcgggctgacccgcattgtttgctaccatgttccctattctgccacgtttttcgccactttgggtactcttatgttaagagttgtcaacttttgtgcgaatcgtgtgccggttgtctagcgcttggtcatttccttctcgatttcctccagcgacttgcccttggtctcgggcaccaagcgcagcacgaacgggatggacagggccgagaacacgccgaaaatcgcgaacgggccgcccacattgttgccgaacgcatcgagcagcacgaggaagaactgggagacgatgaagttgcccagccagttcgccgccgagccgaaggatgagccgatgccgcgcacgctcagcgggaagatctcgccgataagcacccaggcgatcgggccccacgagaccgcaaagccgaggatatagaaagcgatgagaatcatcgtcggcactgccagcacggccacgtcgcccacgaagttcatcacggcgagcaccgcgagcgaaacggtcatcacgatggaaccgaagatcagcatgcccttgcgcgggaaacgatccatgataagcgtggccacgatggtgctcacgaagttcaccacgccgatgcccaccgacacccagatcgcgtcgccttcagggaagccgaagcccttgatgaacacctgcggcaggaagtagatcaccgagttgatgcccacgagctgctggaacagcatgataccgatggcggccaccagcgccggacgagcgatacggaacagttcgcgcacaccacccttggtgtcctgtgcggccacggccttgatttcgtccagctcaatctgcacctgggtctgatccacgtccttgcgaatcagcgtaagcactttgaaggcgttgcgggtgtcgcccttgttcaccagataacgcggggattcgggcagcaacaggccgccgagcagcaacaaggcggccggcaccagcgccgaaccgagcatccagcgccagtcgcggatgccgaagaggttgtggttcaggaatccgaggttggaggcgtaggccagcagaatgccgaaggtgaccatgagctggaacagcgtggacagtgagccgcgacgctccttcggcgccagttcggccaagtacgccggggtcagggcggaggccgcgccgacggcgagacccaggatgatgcgggcgcacaccatcatcgcgaatccggtggaggaggcgcacaggcctgagccgagcaggaacagcagcgcggagacgatgagcagcttcttgcggccgaaccggtcagacagtgcgccgatcgacagcgcgcctgcgcacgagccgatcagcaccgaggaggtgatgaaaccggtctgagagacgctcaggccgaagtccgattcgataagcggggaggcgccggagatgatgccggtgtcgaaaccgaacagcatgccgccgagcgcgccgaaggtgaagatgaatgcgctgttgagcgggaagcgcgtggagaagccgtgcgattcggcggcttcgaggtcctcgattgcgttggctgccgcgtttgtggccgcgcccgccactccggccacgccggtttcgatggtttcgattgcggtggccgccgccccggttgcgctggtttcctgcgccgcggatgccgtctgtttcgatacgggtgatgccgttgtcgtcgtcattgccttgtcctttcgccgttgacggaccgcgcctgttgcgtggcccctctgccgcgtgcaaggtcaggcttcgattgtctgaagtcgcccgaaaacaaaaaaagacctggaacaacgtggaattcgcatattacgatacgcaaattccacgtcgctccaggtcttgcctcgttttgagtaacaaccctgctacgcaacgtgtgtgaaagatagaatacgacttccgcagtcgcgacactccgaataggcagcaaaaaacgatgatttttgacaacgattgcaggattctgcatggtggaatgatgtcggaatgggcgctgcggcaaatacggagaacgggtgtggcgaagcatcatcgcggaacattatggcgggacaccatcgcggagcaccgtagcgcatagttgccgtttcgcgatgctttgccggcattgccgtgcttttggggcacccagcgccgataatggaacacagtggcatacggcagcaaggaggaaccgtggcgaacgcatcgaacgcaacgcctgcagtgattgcggcgcgcatcgtcgatgccgtcggcggccccgcgaacattaccagcctgacccattgcgccacgcgactgcacttcgaactggccgatgccggccatgtcaaccagcacggtcttgaatccatccccggagtcctcggtgcattcccgcgagccggcaatcgttatcaggtcatcatcggcggagcggtcgcctcggtgtacgagcagatcgttcggctgcggacggcgcgattgatgccggcagcgcaattgccatcggcagtgatgcagtcagcgtcgcagtcaacgcaacccactcagtcaatgcagcccactcagccagcgcagcccgcgcagtcagcgcaatccacacagcccacgcaacccgcgcagtccgcgccgtacctttccgacgatgccgcaccatcgcgcgatactgccaccgacgccgaacaaagttgcggcccatccaatacatcccgtcacttcacgcctcgtaccgtccgcgagtggggcagtgccgcccgcgcttgggctgccgcgtttttcgactacctgtctgactcgttccgcccgattctgggtgtactgctcggtgcctcgctggtcatcgccatcgtcaacgtgatcgttgcactcggcatcgtgcctgacggcgagacctccgccggctggatactactcaaggcgatttgggagggtgtgttcaccgttctgccgattatgatcgcctacaatgcggccaagaaactggacgtcgacccctggctcggcggcgcgattatggccgcgctgatgaccccgcagtttactggcgtgatgtccggaatgtccgggacgtccgtatccagcgccctctccggggcgattcaatgctcggccaacgccgtattcggcgccgaaacctgcaccgtgtcggcgttcggcataccgattcaactcaacgactacagcggcaacatcttcgtaccattgctcatggccgccgtgctcgccgtggtctaccgcgggctgaagcgcgtcattcccgacagcgtacagctggtgttcgtgccattcctctcactggtcgtcgtttttgcgctcaccatactggttatcgggcctctgggaatatggctcggcagcgggctgggagcggccacagcatggcttaacgcgcacgtgccattcctgttcgcgctcatcatcccgatgctctacccgtttctcgtgccgctcggtctgcactggccgttgaacgccctgatactgatgaacattcagacgctcggctacgactttgtccaaggtccgatgggtgtatggaactttgcctgcttcggtgccaccgccggcgtactcgtgctggccgtacgcggcaaggattcggccatgcggcagaccgcggtgggggcgttgctcgcgggattgctgggtggcgtttcggaactgagcctgtacggcatccatctgcatcaccgccgcgtctaccgctggctgctcgccggctgcgcggccggcggggtgaccagcgcggtgttcggctggctgttcccgtccgtgctgccatccggacagatggtccggggcgttacgactacggcattcgccttctcctcgttgctgacgattccggtgttcgatcggatgtgggtgtacgcgctgtccatcgccgttgcgtttgtaatggcgatggtgttgacggtgttgttcgggtatcgcacgccgtcgcgcgccaccaagacgcagatggtctcggcagacgagaacgcacgcccgcaggatatggcgagtgggattgacacgaccgtgtcggatgtggagtctgcggaagattctccatcgcgggctgcccctgatcgggctcttgactccaacgccatcttgtcgccggtcgccggccggctggtgaatctggaagcgactggcgatccggtgttcgcctcccgcgcgctgggggagggcgtaggcgtcgtgccggagacgaccggtgagacagccgtgctcgcaccggtcagtggcatactgaaaaccgtggcccgaaccggccatgccttcggcattaaaaccgatggcggcatcgaggtgctggttcatatcggcattgacaccgtcgatatggatggcgagggattcgctgtggtcgtggctaaaggcgagcggatcgcggcgggagagccactggccaccgtggatttcggcaaagtcgcggcggccgggcatagcgttgtggtggtggtgacggtggtcaacgccgctgaactgaccgtggtcacgccgttgattggcgacggtagcggcgacaacaacggcggcaacggcggtgactgcaaaaccgtatcagccggcagcccgatcatcgatgtggaacaatgacgttgcgaaaggatgccatggaaatactgcgagtgttcaacaacaacgtcgtgctcgccaaaggcggcgacggcggtgaggtgattctcaccggccgcggactggggttccaggccaagccggggcagacggtcgacgagtcgaaagtcgtgcgcaccttcgtgccgtcggacgggcgtgacccggaccatctggcgcagatgctggcggacattccgcccgaaatcatccgcgtggtcgtcgaatccatgcaggaagccggactgggggagcgtgagaccggcagcaccacgctggtcatggccttgtcggatcacgtggcgaatgcggtggagcgggtgcggcgcggcatcgacattacctacccgctgctcggcgaggtgagcaacctgtacccgcaggaatacgcgcaggggcgtgcgatgctcgcatcgctcaatgcgcggctcgacgtcacgctgccggacggcgaggccaccgcgcttgccatgcatctggtcaacgccggcttcgccaccggcgacctgtcctatacgtatacgatgacgggcgtgatccagcaactgcttgacattatcgaccacagctacggcatcacgttggaccgcagttccgtgaatgtgggcaggttcatcacccatctgcgttacctgttcgtacgcatccaccagcaccagcaactgacggatgagccggcaccggtgatgaaggtgattcgtgagtcctatcccgccgcgctacgatgcgcgcgaaccatcgcctccctgctcgaactgcgcctcgacacggatatcagcgacgacgaaaccgcctatctggcaatgcacgtcgcccgagtcaccggccacgcatcgtagtaacggattagcggattggcgaatcagcgaatcggctcgagtgtaccggtcatttcggcgaaattcgaggtggcatttgaagcagcggcctgcgcggtcttttccagcgcggaggcgtcgggcacgcgcacgatcagcgcgcggtgatccaccgagaaacggatgtggcgggtttccggcagcatgtcaccgtccacctgcgctttggccggcttttccaatgtgatttcggcactgacgccctgaacctgttcgatggtcgagttcgtggacagcgggttctgttcgggcttgccgatgatcgtctggtgcaccacgtcgccgaacaggttggcccagccgaggatgccgccggtggtgtcgatgatttcgaagtccagcagaccatcgtcataggatgccgccggcatcagcgagaacatgggaatctggccgcagttgccggccatcaccgtgcggaaatcgagattcttgatggtgtgggtcgagccgtcggcgctggtgactgtcagcgtgccgcggaacttcggcgcgaacaggttcttcacgccgcccacgaagtaggcgagccagctgatgttcgccttgagctcggggttggtgtcgtcgatcatggccgcatcgaagccgatgccggcgatgatgaggaaggcgtggccgtggtcgtcctccgggtggtcgagcagggtgagacggcccatgtccaccaggcgggagccgtgggaggtggccacggtcagcgcggcgtcgatatcgtccacgggaacgcccatattgcgggcaaacaggttgccggtgccgatggggatgatgcccagcgcatggccggtgccggagacggcgctcgccaccgtgcgcaccgtgccgtcgccgccgaccgcgatcaccacgtcggcgccgtcctccagcgcctcaagcgcgcagaccctgccgtccttgtcaagctgggtgtcgtagaagcggatgcgattgagccccttggcctcgcagaacctctggatatgcagcctgcgggcttcggcctgcggtttggacggattcacgatgaaggcgtactgcacctcgtcgtcccggcgcttctccagcgtctgagccagcttgcggcggcgctgcgcgcgcagggcgatgacgatgacggcgatgagcaccgccacaatggcgattgcggcgatgatcagaaacacggtgagggcaggctgaggcatggctcctattgttatcggtggggaggtcgtttgcgcccatggtgcgccgtacgtgaacatttcctgcacgcaacagccccgtggggcgtgattatggttcaatcgcgtctcatctgacgaaattggccgggtggacccgtccacggactttcccgggcttccctgtgatttccgcgtgactcccgcgcattcggccattgtcggtgtctgcttacgcggctagtctggtgcccatgcttgatattcaattcatccgtgaacacaccgatatcgtcaaggaatcccagcgcaagcgcggcgagtccgtggaactcgtcgacgaagtgctctcctccgacaccgcacgtcgtgaggcgctgaaggccttcgaagaggctcgcgcccagcagaaggaaatcggcaagaaagtcgcctccgccccggcggacgagaaggccaagctcatcgccgaaaccaaggaactgtcccagaaggtctccgaatacaagtccaaggccgattccgcagccgaggaatacaccaccgccatgtggaagctctccaacatcgtggagcccgaagctcccgaaggcggcgaggatgactacgtggtcgtcaagaaggttggccagattcgcgacttcgcggccgaaggcttcgagcccaaggaccacctgaccctcggcaccggcgtggccggcatcgacatgcgccgcggcgtcaaggtcggcggctcccgcttctatttcctgcgtggccaggtggcccgcatgcagattgccatgctcaccatggccgtggaccaggccgaagagcacggcttcacgctggccatcaccccgacgctcgtgcgccccgaggtcatgcgcggcaccggcttcctgaactcccacgccgacgagatctaccgtctgcgcgagcccgatgaccagtacctggtcggcacttccgaagtggcgctcgccggcatgcacgagaacgagatcctcgacctcggcaacggcccgctgcgctactgcggttggtcctcctgctaccgccgcgaggccggtgccgcaggcaaggatacttccggcatcatccgcgtccaccagttcgacaaggtggagatgttcgtttacgccaagcaggaggactcctacaaggagcacgagcacctgctggccatggaacaggagatgctcgccaaggtcgaggtgccctaccgcatcatcgataccgccgccggcgacctcggttcctccgccgcccgtaagttcgactgcgaggcttgggtgccgacccagggccgttaccgcgagctcacctccacctcgaactgcaccgagtaccaggctcgccgcctgaacatccgcgagcgtatggaagacggcggcacccgcccggtctccaccctgaacggcacgctggccaccacccgttggctggtcgctatcatggagaaccaccagcagaaggacggctccatcgagatcccgaaggccatgcgcgcctacatgggcggcaaggaagttatcgagcccacgaagtgggaggcctgagtctcatcgtgctttagctccctctgatgagggagctgtcagcgtagctgactgagggagagattactgagggagagatcgctgatagccagcaggcgaatccaagaccgaccgcactgccgaatatcaacatccctcccttctgtataatgaatacttgcgcgtgtgaacgcgcatcaggacaggtgtctgagcggcctaaagagacggtcttgaaaaccgttgaggggcaaccctccgcgagttcgaatctcgccctgtccgcgaaccgaggcctgggcaacatgcccaggccctttttttctttttctggaacctgtcttcttgatcgccaccggggtgctgatatattggtttgtgatgccgtaacatgcggtgtccccgttgatatgacgggccaatcggcgtgagccgataagaaaaggcccgacgtttgcagcaccgggcctttgcgttgattaccggcttgcgcctttaatcaacaagattgcaagatgaatcatatcacgatgcacggtagtctgaccgtgaacgggcgcaccgtgatcgtccatgtgggcgatggcgaggcgaacgccacggttgacggcacgcacttcaacgtgcgtagcctgtggcagctctaccagttgctgagactgctcgtgtagcgtctcattaaggcgcggtgcccccctggtcgggtatcgcgccggcgacctgaaaaccgataatgttggcaagtgcttgcaatttgcggtggacgattgcaagctaacgtcttggattgttgccgctatccaatatcgcattaggcctaccggtggaccaaaagtacgttgctttgtaaggggagttaatgaaatgaacaaactcgcacaatcgagcatcgaaccggtttaatgctactcgcctcaacgggacgcgcggtaattgttagctaagttgacaataaaagaatgagggcatacattagtaatcagtcatcacactgagatgatgatttcactacgaaggagtagagatatggtatctcgcaataagcgcatcgtggctgcttttgccgcggtagcagcaatgggaatgggcttggccggttgcggcagcgacactgccggcgacacgaagaccaccgatgatggtggcgtggtcaacatcacctacatgcaccgtctgccggattccgagggcatgactctggtcaacgacatcgttgccaagtggaataagcagcatccggatattcaggtcaaggccaccaagttcgatggtaaggcctctgacatgatcaagaagcttgagaccgacgtcaagtccggcgaggctccggatctggctcaggtcggttacgccgagctgcctgaggtcttcaccaagggtctgctgcaggatgtgacccagtatgccgagcagtacaagaacgacttcgcatccggcccgtacagcctggttcaggttggcggcaaggcttacggcctgccgcaggacaccggcccgctggtttacttctacaacaaggctgagttcgagaagctcggcatcaccgagattccgcagaccgccgatgagtttatcgccgctgccaagaccgctgccgccgctggcaagtacatcatgtcctaccagcctgatgaggccggcaacatgatctccggtctggctggcgcctccggtggttggtacaaggtgaagggcgactcctgggtcgtcaacaccgagaccgatggctccaaggcaaccgctgacttctaccagcagctgctcgacgccaaggcagccaccaccaacccgcgttgggatccgtccttcgatgcatccatcaaggatggctcgttgatcggtactgtggccgccgcttgggaagccccgctgttcatgacctcctccggtggcaccggctccggcgaatggcaggtcgctcagctcggtgactggttcggcaacgctggcaagaccggccctgacggtggttccgccgtggccgtgctgaagaactccaagcacccgaaggaagcaatggagttcctggattggttcaacacccaggttcctgatctggtttcccagggcctcgtgccggctgctaccactgaagacgctgagactccttccgagtggtccaccttcttcggtggtcaggacatcatgaaggaattcaagaccgctaacaacaacatgggtgacttcacctacatgcctggcttctccgcagtcgccgccaagatgaacgaaaccgccgccaaggccaccgatggctccggcaaggttgcagacatcttctccgacgcacagaccacctctgtggatacgctgaagaacttcggcttgtctgtttccgagtgacattaacggttagggttccttccagccgctgatatcctcaaccacacatcgaaaggccggagctcaacactccggcctttccttttactcgagttcggttcgtcattaattgtgtttgatctgactgcatcgattcgaactgcattacgtactttctatttctcactgttcttttgaaagacaggtttccctatgactgcaacaacaaaaacggcgaagacgggggtcgccaggcgtgccgataagccaaaggcttctgatgctgtgaagcgtgagaatcgtaccggctgggccttcatggcaccgtttggcatcctgttcgctctggtatttattcttcccatcatttgggctatttattccagcttcttccgccaggtcaccacgggcggtggcgcatacggcggcggggaactggtcgataagttcgtcggacttcagaacttccaatacgttattacttccggcaacttctgggctggcgtgggcagggtagtgctctacaccgtgattcaggtgccggtcatgatcatcgcggcacttgctctggcaatgctcatcgattcctatatcgtcaagcacatcaccgcattccgtctgagctacttcctgccgtacgccattccgggcgtggtcgcatccatcatctgggtgtacctctacaacggccagatttcccctatcgttaagggacttgccgccatcggcatcaaggtgaacttcttcggcgacaatgtggtcctcggctctatggccaacatcacgacctggaccttcaccggctacaacatgctgatcttcctcgccgcactgcaggccattccgcacgatctgtacgaggccgcacgcatcgatggcgccagtggcttccagatcgccatgaagatcaagctgccgaacgtgcgtgcagccgccctgcttgccatgctgctctccatcgtcggcaccatccagctgttcaacgagccgcaggtgatgtcgatttccgatccgagcatttccaagtcgtacacgccaatgatgatggccctcaatacctcgcagggcacgctgaccccgggtggtgacggacctgcatccgctgtggccatcgttatggcactgatcgctggcgtactcgccgtggtctacacgctcgttgaaaggaaggtgaacgcagaatgagcaccgtagaagctactgataaggaatcccgcgcggtcgcacgcgctcgtaagaaggctgacaggattcgcgacaagcatgccaacgacctgcctcgttccatgcagccttccgcgctggtcaagaccatcaccatcgttgttctggtcttcgcgctgatctactttctgttcccgatttactgggccatcatcgcctcgaccaagacgccgagccagatgaccggcagcaacggtctgtggttcgccgtgggtctgagcgatttgcctgccgccatcgccaagaactatggcacgctgattggttggacccgtggccagttctggcgctgggtgctgaactccctgatctactcgggtgtttccgctctggtgggtacgctcgtggctgtgatggcgggatacgctaccgcaaagttcaacttcaagggtaagaaccttgccattggcgtgattatgggctgcatgctgatgccggccgctctgctgaccattccgcagtactccatcttccatgccatgcacctgaccaacacgatgctctccatcatcatcccgtgctgcgtctctccgttcggcttcttcctgggccgcgtatacgcgcagacctcagtgccgaacgagctgcttgaggcggcgcgtatcgatggtgcaagcgaagctcgcatcttcttcaccattgtgttgaggattctggctccggcaatggtcacgatcttcctgttcctgttcgtggccacttggaacaacttcctgctgccgttgatgatggtctcttccgacaccttgaagccggtgaccttgggtctgtacggcatggtctctctggctaccttcactgatcgtggcgctctgatgatgggtgctctgctcggtgtgctgcctgtgatcgtgctcttcctcggtctccagcgctactggcaggccggcctcgccgctggtgcggtcaagggctgacgcgttaagcggacagcccggtgggctgtctgtagcgtcggcccgagcgaggcggtagccgagcgaaggcagcattgagtctcgccgtaggcgagtccttaattgcaggggccgaaggcgacgcgttaagcggacagcctaagaccaataattcccgccgtccggtgcctcgtgctactccttccggcgccggacggcttctcaacaataagtagcacgcaaccataccgatccagagccttcctgattcttgtcatgagattgtcggtgaaactgaccgggaagctccggtgatgttcaattcgctcttccggcgttgccgtggggctactctcaaggatttatacagtcaggatcctggacgcccgacggttgtgtcggattcttgttttatatgcatatattgtttacaatttaattatccaaaaaaataatcaatgtcctcaaaggagagactatgactagcaccggccgcttcaccttgcctagcgaggagaattttgcggagaagaccaaggagcttgccgaactgtggggagcagacgccattcgtaactccgatggcacgcatctggatgaggctgtgcttgccttgggcaagaagatttacaatgcgtatttcccgactcgcgcgcataacgagtggattacgctgcatatggatgagacgccacaggtgtatctgctgaccgatcgcattctcgccgaatcggatacggttgatattccgctgatggaaagcttcttcgctgagcagctgaagccgaatcgtgatgccgaccctcacaagtattgggaggttgtagaccgcaccaccggcgaggtcgttgattcggcgaactggacgcttgacgcggacgaggacaccgtgcatgtgagcggcgttgccgcatggcatgagtacacggtgagtttcctggcctacatcatctgggacccggtcgagatgtacaaccatctgaccaacgactggggcgacaaggaacacgagatcccgttcgacatctaccatccggccacccgcaagttcgtgttcgacacgttcgagcagtggcttaaggacagcccgcagaccgatgtggtgcgattcaccacgttcttctaccagttcacgctcctgttcgatgaaaagcgccgcgaaaaggtcgtcgactggtttggttgcgcctgcaccgtaagcccgcgtgcgctggatgatttcgaagccaagtatggctaccgcctgcgcccggaggacttcgtggacggcggtgcctacaactccgcatggcgcgtgcccagaaaagcccagcgcgactggatcgacttcctctccggcttcgtgcgcgaaaacgtcaagcagctcgccgacatgtcccacgccgccggcaaagaggcgatgatgttcctcggcgaccagtggatcggcaccgaaccgtacaaggacggattcgacgaactcggcctggacgccgtggtcggttccatcggcgacggcaccaccacccgcatgatcgccgatattccgggcgtcaagtacaccgaaggccgcttcctgccgtacttcttccccgacacgttctacgagggcaacgacccgagcatcgaaggcctcgacaactggcgtaaggcccgccgcgcgatcctgcgttcgccgatcggccgtatgggctacggtggctacctctccttggccgccaagttcccgaagttcgtggacacggtgacccatatcgccgacgaattccgcgacatccacgaccgcaccggtggggtggccgccgaaggcgagctcaacgtggcgattctgaattcctggggcaagatgcgttcctggatggcgttcaccgtggcacacgccctgcccaacaagcagacctactcctactacggcattctggaatccctgtccggcatgcgcgtgaacgtgcggttcatcagcttcgacgacgtactcgcgcatggcatcgatagtgatatcgacgtaatcatcaacggcggcccggtcgacaccgcattcaccggcggcgacgtgtggaccaacccgaagctcgtggaaaccgtgcgcgcctgggtgcgtggtggcggcgcgttcgtgggcgtgggcgagccgagctcggcaccgcgcttccaagcgggccggttcttccagctggccgacgtgattggcgtggacgaggagcgctatcagaccctctccgtggacaagtacttcccaccggtggtgccggaccacttcatcaccgccgatgtgccggtcgacccggcggcccgcgaggcttgggaacaggccggctaccgcatcccgctgagcggttgcggcggtggccagtccatcaagccgttgggcggcatcgacttcggcgaacccgtgctcaacacgtatccggtcaatgaaaacgtgaccctgctgcgcgcggacggcgggcaggtgcagctcgcgaccaatgattatggcgaaggccgcggtgtgtacatctccggtctgccctattcggcggccaacgcccgcctgctggaacgcgtgctgttctacgcctcccacaacgaagacaagtatgcggcttggagctcgtccaatccggagtgcgaggtggcgcacttccccgagcaagggctgtattgcgtaatcaacaacaccgatcagccgcagaagaccacggtgactttggccgacggcaccaccgaggacttcgacctgcctgacagcggtatcgcctggcgtgaagcctgatcccacgttttggagaacggacccatcatgactgaaagcaatgaagttttattcggcatcgcctcgcattttgcgctggaaggtgccgtgaccggtatcgaaccttacggagacggccacatcaacaccacctatctggtgaccacggacggcccccgctacatcctccagcagatgaacaccagcatcttccccgatacggtgaatctgatgcgcaatgtcgaactggtcacctccactctcaaggctcagggcaaagagacgctggacattgtgcccaccacctcaggcgccacctgggccgagatcgatggcggcgcatggcgcgtctacaagttcatcgaacacaccgtgtcctacaacctcgtgccgaacccggacgtgttccgcgaagccggcagcgcattcggcgacttccagaacttcctgtccgaattcgacgccagccagctgaccgaaaccatcgcccgcttccacgacaccccgcatcgtttcgaggacttcaaggccgccctcgccgcggacaagctcggccgcgccgccgcatgccagccggaaatcgacttctatctgagccacgccgaccagtatgccgtcgtgatggatgggctcagggacggttcgattccgttgcgcgtgacccacaacgacaccaagctcaacaacatcctcatggacgccaccaccggcaaggcgcgtgcgatcatcgatctcgacaccatcatgcccggctccatgctgttcgacttcggcgattccatacgctttggtgcgtccactgctctggaagacgaaaaggacctcagcaaggtgcatttcagcaccgagctgttccgtgcctacacggaaggattcgtgggcgaactacgtggcagcatcaccgcgcgcgaggccgaactgctgccgttcagcggcaacctgctcaccatggaatgcggcatgcgctttctcgccgactacttggaaggcgatatctactttgccaccaagtaccccgagcacaatctggtgcgcacccgcacccagatcaaactcgtgcaggagatggagcagaaggccagtgaaacccacgccatcgtagccgacatcatggaggctgccaagtgagccgtcagtcgaaccatacccgaaccagcatgatgggggccgagcaatgagcgatcagctgaccgaggtatacgccagcatcgacgccctagtcgattacgccttggatcatctcgacctcgatccacgcaacgcagactggacccgcaaccaaatcttcgccctcttccacctggattcctaccccggacccaaaaccacaacgtcggcggcgtcagtgtcagacgcagtccaagacattgtcggcagccgaagccaggccccctctgacgaaaagacccccgaccccctactcgccgccttccgcgccgccgccacaaccgccggcctcttcgatccggaggaaggcccggcctacgccgacaccatcatgggcatcctctccgccaaccccgccgatctcgacgaccggttcctgctcatcgagcacagggacggcggcatggccgccatgcaatggttctacgactactgtgtggccaacaattatgtcaagcgtgcccagctcgaccggaaccagcgcttcgactcgcacgggctgacggtgaccatcaacctcgccaaacccgaattcaagaacatgaagaaggcggcggccggcaacgccgtgtccggcggctacccgaagtgcacgatctgccatgagaacgagggcttcgccggacgtgacaagcgcacgctgcgcaccctgccggtcacgctcggcggtgagtcatggttctggcagttctcgccctacggctacttcgaccagcacggcatctgcgtgaacaccgaccacacgccgatgcatgtggaccgcgacactttcggccatctgctcgacttcgtggaccgcttccccggatacttcctcggatgcaacgccgcgctgcctcgcatcggcggctcggtgctcgcccacgaccactaccagggcggcggcgaactgctgccgatgcacaaggccgccacttgggccgccttcacgctcgccgactatccggacgccgtggtcgaaatcctcgactggcccggtaccgccgtgcgtgtggtgtcgaaaaaccgccagagcatcatcgacgtatccgacatcatccgcgaggcatgggtcggttatgacgacgcgtcgaacggcatcgccagccatgacgcggacggcaaccgccaatccgccctctcgcccagcgcgatcatcaccgaacgtggctatgagatgagtctcatcttccgcaacaatgcgatcagcgacgagtacccggaaggtattttccatgcacaccccgaatactggccggtcaagcaggagccgattggactgatcgaagcccaaggcctgttcatcctgcccggacggctcgtcgaccagctcggcatcgtcgaggaggcgctcgccgaaggccgcgatttgcccgataaagtcagcgaattcagtctcgaatggggcgaactcgctgaaacattggccggaaaccgcgaccgcgaggccatccaccaagccgtacgtgacgagctcggcagcgtctgctaccgcatcctcggcaacacggccgtcttcaagcagaaagccaccacgcaaacattcctcgaaagtcttggttttgccgctaggtgaaacaggtcaagtgaagtaagctcaatactgaaggaaaaccgaaggcaagtccttccaaaggaggagatatgaccactgttctggttacgggcggtgctggattcatcgccacccacaccgacatcgaactgctcgacaagggctacgacgttatttccgtagataactacggcaactcgtctcccgtggcgcttgagcgcgtcgagcagatcaccggcaagccggtcaagcgttacgacggtgacgtgcgcgatgaggcgcttatggaacgcgtcttcaccgaaaacaacatcgattgggtcattcacttcgccggtctcaaggccgtgggcgagtccgtggccaagccgatcgaatactacgacaacaacctgtactccacgcttgtgctgctcaaggtgatgaagaagcacaacgtcaagaagatcatcttctcctcctccgccaccgtgtacggcacgccgaaggaactgccgattaccgaggagacgccgaccggcggcaccaccaacccgtacggcacctccaagctgttccaggagcagattctgcgcgacgtacatgtggccgatccgtcctggaccatcgtgctgctgcgctacttcaacccggtcggcgcacacgagtccggcctgctgggcgaagatccgaagggtattccggcgaacctcaccccgtacgtggccaaggtcgcggtcggcgagctcaaggaagtccaggtctacggcgacgactacgacacgcccgacggcactggtgtgcgtgactacatccacgtggtcgacctggccaagggtcacgtggccgttattgaccacatcgacaaggaaggcgtgttcgtctacaacctgggtactggccacggctactccgtgcttgaggttatcaaggcttacgagaaggccgccggtcatccgattccgtacgcgatcaagccgcgtcgccccggtgacatcgccgcctgctacgccgacgcttccaaggcggagaaggagcttggctggaaggccgagctgaccatcgacgacatggccgcctcctccctcaactggcagaccaagaaccccaacggtttccgcgacgcggagtgatatgagcagatgagctccctctgatgagggagctcattgtcgtttcatcacacgatgcgcctatcggcggcccagcgggtgagctcggtgcgattcgaaagctgaagctttcgcagcaccgagctcacgtgcgtttcgaccgtcttgatcgaaatgaacagttcggccgccacctctttatatgtgtaaccacgcgcgatcagccgcatgacctcctgctcgcgggcggacagccggtccagctcctcatcatgagcccgtgccgcaccatcagcgccgccatcagaccccgccgccggcacaccctggaaggtcgaaagtacaaaaccggccagttttggcgagaacacggcatagccctcatgcacctgcttgatggatgaaatcaaatcagcgccggtaatcgtcttggttacatagccctgggcgccggcgcgaatcaccgaccccacatcctgcggcgcatccgaaaccgacaatgccagaaacacggtagtgggggagtagggccgcgatttggcgaggatctcggcaccgccgccaccctcgccgccgggcacatgcacatccagcaacaccacctgcggcttggtctgtgcgatcatcgccaccgaaccgggcacgtccgccgcttggccgacgatatcgaaggaatcgcgcaacgtggcgattacgcccgcacggaacatctcatggtcatcgaccatggccacacgaatcttggctgtctcgttctcgctcatcgatgttctccctgcgccgctttcagcgcgatcggcatatgcattctgacctcggtgccccagccggccctggacactatctccactgtaccgccgcgccgtttgatgcggccgataatcgattcgcggatgcccagccggtcgggcggaatggcgtccatatcgaagccttcgccatggtcgcgcacgaacacttcaaccatcgtgtcgctggcctcgcaatacaaagacaccggctcgccgccatgcgtgaccgcattgaccaacgcctgacgggtggcgtccagcagcgcatcggtctgggcgctcggccgcgcgtcgcccacggtgaccacctcaatcggcttgccgtgctcgtcctccacctcggcggcgatctgcttcaatccggctcccaccgaacgatccgatgtggaacgttcctgatacagccattcgcgcagctcgcgctcttggctacgcgccagggcgaatacggtggtcggttcctcggagttcagctgaatcagcgccaacgtttgcagcacgccatcatgcagatgggcggtcatgtccgcgcgctcctcttcgcgctccttcaatgcctgctcgtgggtgagtcgttgcagcatcgcgttcgcccacggcatcaccgccaccacgataccgacgatcatcacgaatccgctggcaacaatgcgtcgaggagaggtgccccacccaggaatgctgacattatgcacatacaatgcccatcccatgaaaatcagtgcgatgccgcccaacatagacaacagctgcgtgcctcgcggactaagattcatccatgccagtgcgatgccgcccaaccctaccagcagcggaaacacaatctggacatccgcaccggtgctggtgagcaacagtccagtggccatcaacgcgaaaccggccaatgccacgacggccggtttcggagcacgttggatggcctcggacaatgattccggtgcggcagccgattcgtcgtcatgagcggcaagtggctgattgcctcgcgcaagcggcgcctgatcaacgggcactgtgcgagccgcagccgccaccgggtctccggcaggcatgaacacccacaggaatacataagcgatgatgcctgcgccgtagaggacggtcagtgcgatgaacgcaatccgaacccatgccacgccgatgcccaagtgcagggcgatgcccttgcacacgccggtgagccaacggccctgccgggggcgcatcaacggcatgcgcgcgggcagcaatggttcgggagatgacgtcatactcctattgtgccgcgctcagggcgttgcggccggggttttacccggtgttcagggaacaatcagggtgttccccgagcgttgtggcagtggtcgggcggtgtaatggaatcatgagcaatccaaacgcgaatccatatcagccacagccgcagcctggtccgcaaaaaaacaagacatcgcgacgcttcttcacttgggtgcgatccagtggactggttcgcggcgacgaccggtggatcggcggcgtatgcagcggcatcgctttacggcttggctggagccccacattagtacgtgcgttggtgattgtatgtacattgttcttcggttttggcgcagctctgtacgcactcggctggtttctgatgccggatgtacgcgatgggcacatcttggccgaggacctcattgccggccaatgggactggaattgtctgggatgcttcctgttcctcgccgtggcaatcgtgattccaggtgcggggtggggttgtattgcgctcgccgccttagcgctatggctgttggccaaaagcggcattcgccagcaggaagggtacggattcggggcatctgcgccgcgaccggtttcacagcctgtgtcatatccagctccacagcctgtctcatatccagccgcgcaaccagtacctcaatctcctttgtattcagctccgcaaccttttccacaacctgtttcacaacctgtttcacaacctgtttcacaaaccgcgcctagtgtttcacagcctgtttcacagcctgtctatcagtcgatgcccagcgcgatgccaggcacagtgcccggcgcgatgcccggcacagtacccaacgggccgtttgcccccgaccgtatgaatgcgacggcctatgcccccaccgagtccaagcgccgcaagccggcgggcccaatcgtggtcttgagcatactgggccttaccttcctctcctttgccggtctgatgggactgatttgggtaaacgacatgggcattatcggcattatgcgtctgggcaccatctggattgccgcagtatgcatagtgatggggctggtggtcatcattctcggattcagaggacggcgtaccggtggtctgattcctctcggactggttgccggtggatgcgcgctctgcatgaccatcgtttcaggcacgtatggcgtgtactaccgtgatcttggtgccagcggcatcaatactgttgtttcactgagccaatctgtcagtgcgagaaacagcgacggcatgaacgatgtgcaaaaggatggcatcttcgttgccgatgccagcgatgccacgtttgaaacattgcagcaaggtgtggcgttcagcggtgaaaactacaacaccgatcaggcaatcattgattggtccgattgggacaagacacatggaccgcacacggtgaagatgctggatggcaaaacttccatcagtaattgcccggtcggtaccatcaccatagccgcaacacaggcgcaagtgcatatcgttctgccggattcctgcacttacgccttcggcaccgccgactcctactactccacttcgagtgacgttggcggcaaatacgagatggtatacaacaactacatgggtccaagctttgttttcttcgaagctgaaagtgccaccaatgggcctgatcacgaatggttgtataaggaatccgccatgccggacaacggcccagaattaaaaatcaatattccctatgcggtggaagcacgcgtcaacgtggtgtacgcctccgattggggaggctccacgttccagccgcttgccgatatatacgacggcaacagcacaagcaagaacacaaccgaacaatcggaatgatcaagccgttacaaccaggagatggaatcatgactgatgaaaccaaggaattcgcctccattgaggatgcgacaccgaccacggccataccttccgaaaccgacgcgaccaccgcgaccacgaccatggtgaccgtcgatggccgaaccgataccacggtgctgccatccgcagcggatgatgacgaaacggctgtgctgcccgtccccgacaatcatgcggatgcgtcggtctcggatgtggatacgcaggcaacagctgcctctccatcgcccatcgaaccaaccacagatcggattgccctggaaacagttgccgatgccgtggagggagatggtgggccgattccatctgccgatgatgtgccgatgtacgcagcatcttcagcacgacctccctatgggcagtctcagaccgccggcaaaccatgccagcctggggggagcgccaagaacgtccagagcgccaagaacgtccagaatgctaaggatgtcaagagtgccaagaacatccagaaacagagcaccagcgcgcctactgtggtattcggactattaggcgtgattatcggcgtgatcgcgctggttttcgggtacatatctccggatcggatgatttcgttgttctcgccgaatccgcaattgctgacggctattatttgcgccgtagtgggactgattctggtaatagtggccgttgtatgggccatagtcggtgccgtcaagaagagaaaatagcgttacaaccattgcattacggtcccagtagaagcacattatgacgggagccgaccgataagagccgaccgttctatgctgatgggggggaggcatagtaactatgaaacggatttcggcgcggcgggtagcgagcgtcatcgtcaccgcgatggcgatgacgctggtattcgccacacttggctgggcgatgatgccgcaatggaacacacggccctacaccaagcacatcgttatcgcttctgccgacaccaccatcacccctgcccatgcgaacattccccacgaggggcgatatcgtacgcgtgaaacccgactatccatcaagaccggcgacggcgtcacgctacccgccgtactacgtgaaccggtcggcgctcccgggccacgcccggcttgtctgttcattcacgggtccggtaccagtggtgccgaggatttcggcgatatcgccaacgccatggcctctgccggtatcgtgaccttggtgccggccaagcgcaacgacaactacaccgtgctgcatcgcgactacccgcgttttgctcgcgaatacgggcgttcgctcgacgtgttgcgtggcataagcggcgtggaccccgccaaaaccggcatctacgccgaatccgaaggcacctggatcgccacgattctaacctcgaaacggcaagacattgcctttgccgtacttacatccgcaccggtgttcaatggacgtgagcaaatggccatggctgtcagcgcctatacgcatgaggccggcgcgcccaagcccgtggtcaaagacatggccaaattgatgtcgctggactacgcgccattcgatctggcctatgccgactttgatgccgaccggtatctgaaatccctcaccatgccggtgctggtgaactacggcacctacgatacggccatgcccatcgaacagggggcgcagcggatcatcgccacggccaacaagtccggcaacgagaacgtcaccgtacgctatttcgccggcaaccatcagatgcgggctggtgagggcttattcaccccgaacctgccattggccgaaggctatacgcaagcgctggaaaattgggtgaacggtgtgactgccggaaccaaagccgatggatgggcaacgccccaagtcgccggtgcaacacctcaccagcgcttcgccgcgtcgcaacgtaccagatccggtatcgtcggctcgcttggcgtgctggccggtctgatggtggcagggcccgtgctgatcgtgatggcggcgatattaggtattggcttgactgtgttttcttggctacagacgttgctggccgggcgacgtagtgtggcgactgtgcgggccgtgcatgcgacgccgagtgagctgggggccgcccagcggcgcatgttgcacggcattgccggcttatctgccggtatcggcacagcggtgatggtgattactgggctgttgtacggctatatgagcgccgtaggcgtatcggctgtattggttatgcctcaaccgcggctgtttgccgtcggatgggtggtgctgcgaatagcgaccatgctgttggtggtgctgtttgcttgggaaatggaacgtgtctggtattgccgcgccgatatcgtcggtgtgcggcgcgtcatatgcgtgatggtagcgctcggcactctcgccacactgatgacactggcattttggggcctattctcgctgtaattctgccgatgtgcgctggtaaatggggcctggcgggcaggctgcgttggtggtctgggtgtggggcgatcggcagattgcgttggcctgggtatggccggccgacgtacatcagtcggggtgtccgatacacagtgaatggctgagtattacgcttgggaggcttcggcctcctctaaggtgtcgaaaccgccgagctggactgtgtgcaacaaggtttcctcagtgatattgcgttgcgggctggctgcggcgcgctcgccaatcatcgcttcgtaacgttcgaaggtctggtcggaatacgtaccaagctcgccgcgcagataggtttcgaatgaggtggcagatggtgtgtcttcggtggtggtgagtgcgcgcatcgcctcgccgagcttggggtagcgctcgcggaaatccttggcccaggcgacctgctgggcgatggcctgttcctgacgggccgcgcgctcttcagagagacgcggaatatacggctctatgttcttcgtgaaattttccggtgcggtggaggccatcatgcggccgtatttttcggttacgaggttgcggcccacgtggtcggccgcgtcaagatcagcggcatagctggtgagtaatggccgctcccatgtgaggaactgggccaaccgcatctggtggaacaccggccagttgccttggcatgccgcgcgtccaccctcattgttggtgcgctggaactgatcccattcatgacgcacaatagcctcgcgcagttcatcatcagtcagttcgttggtcatcgacgttcctttcactgatacctccctctgatgagggaggtggcacggcgaagccgtggcagagggagcttgaatctacaaacttttaagcaccggatcatcagaggcgatgtggtcctcgacatacgggcgctgccattcgaggaaggtctcgccggacgtggtcaggtgttcgcgtttgagttccttgacgatatccaccgcaatctgctccacaatatcgttgattttctcgattgctggagccgcgcccttgccgccttcgccaaatccggccccgccatagcaggctgccgaactcaatcgcatcacggtttccaactgttcgcccacgttcggcaacagcgcgaacatcgagccagacagcttgcgcaatgctgcgaactgccacttgtaatacggcatatagcccaccaccatcggcacgttaaccaggaacaccaacgaggcggtggcctgcacgaactcgtggatggacagccatgcggccgcgccgtcgccgcgcttcaacgaacgcggcagattatattgaccggcctgggcgatcatgccgagtcgcttggagatcagcgcgagccgcacatcgtcgggcatgttcttgaacccttggcgcgtcttggaaaacagaccggtgggatcggcgaacacctcgccattggtggcggcggccaaggtcgattcctgaagcattagccactcatgcggcgcggtctgcgccggcgcagtgtgatacccggtgatcgactcaaagaagtcaccgatgcggaacacgccgtcacggcgattcgcgccctgtgcgcgcggcgtgacgggggagagcggtgcatcaatcggagtcgtcatcgcttccgccacatcagaggacgccgcgcctgactcggcagtggcggtatcgtgcgtagcggtgccgggggtgggtgcgtttgccgcatcgggtatgacggtggagcctgcacctgcggaggggaatgctccggaagcatcggacctggcatgcgcctcgaacgtcacgcggccttgcgcatccacgctgaacttgcgcggcagtgcctcgtaatcgacctcaagttgctcgccgatcgccgcgtaatcctcatccgtaagccacaggcagaagcgcgggccgaaatcgtggtcctgcgaatacgcatcatcgaatccgtagcattccgagccatgacccaccagaccggcggcgatacgcccggcatactgcggatacttcgccgcaatcatcggcttgcccatctgcgtccagaacgcgcgggccagcttcagtccggacaccgggcatgcggaaacggcctcggccgcgcccgcagaaccggtcgacaccgaaacggtggatggggaagatgtcgcgtccgcaccggtcttgccctgtgccgggctgttcggcagccgcgatccggactggggtggcgtgcctgcatcgccggcaacacccgcattgtcaaccgtcaccccggccttcgccgcctcttcctcggcctgccgcagattgtcggcggtgatacgccagtaatcggtgtccttgccgtaacattcctcgatcacggccagcgcatgccggtatccagtaactgcatccgcatgccgtctctcggcaaagcacacctgcgcgaagcccgccagtgcggaggcataatgcgcggaatgttccagatggccggtgcgatagatttccagcgccttggctgcatgccaatgcgcgtcctccaacttgtgttcggtcagcagggtcaacgccagattcgtgtgcgagctggacacgtcgatatccgcgtccgggttcacgctcgaggcttcgataatgcgcagcgcttcacgcaactccagttccgccttgtcgggccgattcgtctcgctgtagagcatcgacagattgttgtgcagtgctgcgagcctacggtcggtgggcgccagcgaatgccggcagacactctgcgcctgatgatacaaatcctcggcctgatcgtattgtttggccgcgcgcatcgaggtggcgcaattgattagcgtggtggcccacgcctcggatgtgccggtggtcaagcccatacgagcggccagttccagcgctcgctgcacaatccactgattctccttgtgccgaccttgcgagcgatagaagcccatcgtttcgttgagcacggtgagcagtccggcctcgtcgccggcgttttccgcgtccaccatcgcctgttccaagtacgggccggcttcggtggcggccgtgtggcgatcgaaaatcgcgtccagtccgttcaggaattgttgggtatcaaaggttgcgggcgattgatcggcatcgtccgtggcctggttcgcagtagaatcggcaccttgcgctgcggccgccgcatcggtgtcgtcggcatcgtctggaccatgcgcgaattgtgcggcgaattgtttgagcagtgcttcctcgtccataccgccagacctccctgaatcgtgtctgatttcagtctattaatactgtgaacaaacgcgtcagggagtttgctgtgagcttggtctcagtccaccttgatttcgcgcatgcggtgaatggcgtcggtatcggtttcgcagcgccacgagtagaaggccagcagccctacggcaagcagggccagcggcataccgcccagaccggtatagcgatagttcatcgagaaggtggtgagcatcgcgccgccgacaatcgagccgatggcattgccgaagttgaaggccacctgcacggctgcgccggcgatgagctcgccgccgccttggccggcttcggtcatcagcaattgctgtggagcggaagtaaagaacaatccgacggcgatccagaacgtcagtacagcggtcatcggctgattgcccggagtgatcagcaccagcaacaagccgaggcaggagatggactgacctattgcggccgcgccggcatgcctccaatggtcggtcagacgacctccaagcagaccgccgatgaccataccaaagccggcaagcatcatcagcatcggcaccagggaagacgaccatccgccggttttctgcagccagggggagacgtagctccaccagcagaacacaccggcattgccggtgaacacggcggccaaaatcacccacgggccacggcgggtgaggaacttgaactgaccggcgatgcccgcgtctttaatcggtgcaacgtacggaatccacgccaacgccagcacaatcgtcattgccgcccaagcggccaaaatgccgaaggcaagacgccaggaaaggaactcggccatcagggtgcccgccggtacgccgagcatattggccacggtctgtccggtgaccatcacggatacggcctgcgcttccttgcctttctccgccagagtcttggcaatgagcgtggccgtgccgaagaacgcgccgtgcggcaggccggcgacgaatcgtgcgacgaccagcatggcggcattgacggagaatgcggaagccagattgcccaccaaggcaatcaccataaacaatatgatgaggttcttcggcggcaccttgcggccgaataccagaatcagtgtgccgaagcacacgccgatcgcatacgcggaaatgtaatggcctgcggtggggatgtccacgccggtggcggccgcggcctgcggcagaatgcccatcatcacgaactcggcggcaccgagaatgaacgcgcccgaagccagtgcaagcagactcttcttcatggttcctctaactacttcagtattacttacaaaaacagtgcggcaatcgattgattcgagcgatatattacggtggtccgccaacaaatacggggcttgccgtgatgtggtttgtcgctgtgtgcggcgggttgtttaccgctgttcgatcgcttggtttgattgttgggacaggaaacgaaaaaccggattgctgatttctcaacaatccggtccagttgtcgggctggcgggatttgaacccgcggcctcttcgtcccgaacgaagcgcgctaccaagctgcgctacagcccgtttggcaacagacgtagatattacattgtggtggtggacaatgcaaatcggcatgtcgcgagtgttgcgtgatggtggattcgccatgtgtacaggtctctcaagccttgtgcagagccggttttgcgtcatgtgagcgggtgttcggatggccgtgcggtctgccgggctcataatcgccggccttgcgtacactgatgaatcatggctgaagttgtcgaaaataccgaaaacactgagaatgaaaccccggccgtcccgcagatgagcaccgtcgaacgtgcggaaatgctgctcgagcaggacgccaccatccgcgagaagatcaagtccggtgccacgctggacgaagccgtggacccctccaacaaggagttcggcccgctggctcaccccgagcaggtgcagatgcgcgtggccaagcgcgcgatgatgcttgaggccggcatcgccccctacccggtgcacttggacgtcaccgacaccatcgaggcggtccgcgccaagtatgacggcaagctcgaggctggcgaagagaccgaagacatggtcggcattgctggccgcgtgctgttcctgcgcaacgcgggcggcctgtgcttcgtgcagctgtccgccggtgacggtaccaagattcagggcatgatctccaagaaggagattggcgccgactcgctcaagcagttcaagcagctcgtcgaccttggcgatcacctgtacctcaagggccgcgtcatcgcctccaagaccggcgagctgtccgtattcgccactgagtgggctatcgcctccaaggccctgcagccgctgccggccctgcacaaggacctgaacgaagacacccgcacccgcaagccgtacatcggcatgatcgcggacgagaacatccgcaacatggtgcgcaaccgctccaaggccgtggcctccctgcgccgcacctttgacgaccacgacttcctcgaggtcgaaaccccgatgctgcagaccctgcacggtggcgcggccgcccgcccgttcaccacgcacatgaacgccttcgaccttgacctgtaccttcgcatcgccccggaactgttcctcaagcgctgcctggtcggcggcatcgatcgcgtgttcgaaatcaaccgcgacttccgcaatgagggcgtcgacgccacgcacgcccccgaattcaccatggtcgaggcctaccaggcctatggcacctatgattccatcggccagctggtcaaggaactcgtgcagaagaccgccatggacgtctacggctcgcacaaggtcaccctgctcgacggcaccgaatacgacttcggcggcgaatggaagaccatcagcatgtacgattcgctgtccgaggcattgggcgaggaaatcgtgccgaacggcggccctgagcatcccggcacctccgttgagcatttgggcgccatcgccgacaagctcggcgtggagcgcgacgacgtggagaaccacggcaagctcgtcgaacacctgtgggagcacttctacgaggacaagctttacgagcccaccttcgtgcgtgacttcccggtcgaaacctccccgctggtcaagggccaccgcaccaagcccggcgtggtggagaagtgggatctctacgtgcgcggcttcgagctggctaccggctactccgagctcaacgacccgatcgtgcagcgtgagcgtttcgtggcccaggccaaggacgcactcgccggcgacgaagaggcctgcgacatcgatgaggacttcctcgaggctctcggcgtgggcatgcctccggccggcggtatgggtatgggcattgaccgactgcttatcgcgctgaccggtgccacgattcgcgagaccatcaccttcccgctggtcaagccgctcgttggctgattaggcatactctggctcccctcagagaggggagccagagttatatatgaaagggattgcttatgtctatcggcttgtgggttcggggcgcgcgtcccaagaccttggtcacttccatcgcgtcggtgatggttggggcggtgatggcgtacgtgcatatcgagcggtcgggcacctgcatcgcaatatatccagaaccggcctcctgcgccacggcccgtgaacagcagaccctgctgatggaccgattctggccggtgaccatcctgtgcctgctagtcgcgctgttcctgcaaatcgccgtcaactatgcgaacgactattccgacggcatccgcggcactgacgccgggcgtgacacggacgaatcgaaatcaggcaaaccccagcgactgaccgcatccggactggtaccggccaagcatgtactgttcgcggcgatgatttgcgccgccatcgcctgcatatgcggtgttgtggcggtcgtgctcgcccaagcatggtggttgctggccgtgggcgcggcctccttgctggccggctggttctacaccggtggcaagcatccgtatggatacgtcgggctgggagaagtcggcgtgttcctgttcttcggcttggctgcggtattgggcaccgaatacgcgctgtgcggcacggtggacgtcggcggactattgggtgctgtggcggctggcctgttctcctgcctgatcatgatggtgaacaatatccgtgacatcgacgaggatcgtgagcatggcaaacacacgctggccgtacggctgggggagtccggcgcgcgtacgttgctgattgtgtgctgcgtcatcgcatggatcatcgccctgctgatgtgcggtacattatggtggccgtggggtgcggtgctgttgctctcgggcaccggaatacctgtgcgcatggtctccagcgtgaataaacgtcaattccgcccggctctgcccgccgccagcttccagaccttgctgtttgcggtggtgctggcggttgccgtggcgctatgagagcgaaataataagacgaatactcgtgtttgggcgcacgcggctgtagactgaaccgtatgacttataaactagtactgctccgtcatggacagagcgcatggaataaaaccaaccagttcaccggctgggtcgacgtaccgctgaccgagcagggtgaagccgaagccaagcgtggcggcgagctgctcaaggagaagaacgtccttccggacatcgtgttcacctccctgctgcgtcgcgccatcaacaccgccaacatcgctctggatgccgcagatcgtctgtggattccggttcagcgtgactggcgtctcaacgagcgtcactacggcgctctgcagggcaagaacaagaccgagatccgcgaagagtacggcgacgagaagttcatgctgtggcgccgttcttacgccaccccgccgcccgagatcgacccgaacgaccagtacgcccagaacaacgacccgcgctacgccggcgatccggttccggaagccgagtgcctggccaacgttgttgagcgtgtgaagccgtacttcgagtccgctatcgagccggagctcaaggccggcaagaccgtgctgattgctgcccacggcaactccctccgcgccatcgtcaagatgctggacaacctgtctgaggaagagatcgccaaggtcaacatcccgaccgccatcccgctgctctacgagctggacgagaacttcaagccgatcaagccgcgtggcgagtacctggacccggaggctgctgctgccggtgccgccgctgtcgccgctcagggccagaagtgagcctaagccgctaacacggtacaagctgtaaggggagtcgcacataacgtgcggctcccctttgctatgcctgccaaatcccccatggggcggtgattaccccatggggcggtaaaaccctcatggggcggtatgccagaatggcttaattccgcggtttcacatatccttcaaaccgccccatgggcaagttaccgccctatgggtgttttgccgccccatggatacgccggtgtaccgcccaaaagcaacaaaaaacggcgtccagccgtagccggatcgccgctttcgggcatcctcctcaaaccacaggagaacaagtgttcagttattcgcccaatgtgagaacaagtcccaatcagtcgatgtcggtgccctcgtcgcgggtcggctccttagtggggtcgaagccggagacgatgtacaccacacggcgggcggcggacacggcgtgatcgccgagacgctccaggaagcggcccagcagcacgatatccacggtctgctgacgggtgatgtcatcggacagcgctagatcgaaggtctggtggtgcagattgtccagcttgtcgtcagccaggatgatggcctcggcggtcttggcatcgcgatcgaagagcatggccaccagctggtcagcggtgttgtccaggaagtcgatcatctcggcgaacaccggttgagcggattcaggaatcgcggcggccggataggtgcggcgagcggcctcggccacgtggcgggcaagatcgcccatacgctcgaacgtggaagccagacgcatggtggaaacgaccacacgcagatcggtggccaccggattctgcttggcgagcaacttgacgcactggtcaatcacagaggactccagggcatcgatttcgatgtcgccgtcaatcacagtctgtgcggcttcaacgtcctgattcagcagggcttccccagctcctttgatcgccttgcgtacgttctgcgccatacggtcgaggtcgtcagcaacctgcttcagctcctcgttgaaaataacgcgcatttctctagcctttcatgcttgcttattgcaacctgtaccagtgtattattccagtacttgttccccacttcaacgtaggtaatggcaacctcaagttgttctactgttcattgggttgttcacctgaaattcatgttaccggcgtgccggcaaaccgcaatcccggcgtgtggtgtgaaagaatgggggcatgacacagatgccgctcgtcgccgcgattgctcttattgtcacggctgttttatttgtggtaggaatcatcacgctcatcgtgggatttgcgacacatcgagtgtccatggaatcgccgctggccgatgatgacgacaatgacgatctgtccgacgacaccgccacgctgctgtccatgctgccaggtgcgtccgtggtggtcgacgagcacgacgaggtggtccgctgcaatcccgccgcctaccgcctgggtgtggtgtcagatgacgccattgcccagcagcatgtgctggatgccattcacgaggcgcgcaagtccggtggcaagcgccagttcgacttgaccaccgatactccggagcggtacgtcgcagaccagaacaagggcgatcacgtcgccacgcagtccgtccaccgccccaactggctgaaggtgactgtagggcgtatcaacgagcagttcgtcatcgtgttgattaccgatgtcagtgatgtgattcgtttcgctcaagtgcgtgactcgtttattaccaatgtgtccgagcaattgttgggccccaccgaagctctggccaaactcgccgattcgctggagtccggcaatctggacgaacagcaggtggctgccgacgctcgccaggtgcgttccagctgcagcaagctcaaccacatggtgtctgatttgctgctgctcatacgcgcgcaggagccgattacgccgtcttccgccaaccgactgaacgttatggaacagctcagggccacggcggcgcgactggagccgcaggcagccgaggctggcgtgcagctgaacatcaagggcgacgatgatctagtcatcaatggtgaggcggaccagatcgacagcgccgtgaccaagctcatcgaaaacgccatcggctattccaaggaaaatggcgtggtcagcgtgtccgcatccaaagacaaggatggcgaccgcgcggtgattcgcgtgattgaccaaggcacgggcatcgctaagaaggaccaggcgcgcatcttcgagcggttctaccggggcgtggaacagagcaatcgcacggcggatggcgtgggcctaggcttggccatcgtcaagcatgtggcgctgacccatcatggcgatgtgaccgtatggagcgcgcccgggcaaggcagtacgttcagccttacgttgccgttggcgcagtgaggtaaggaattggtggcatgccttgcatgccaccaatgctgtttgatgagcgacctgcggccgcggtctctccctcaatcagctacgctgacagctcccgtcatcagaaggagcttgtgttgcgttactgtccgaggcggcggtagtcccagcggtcgaagtattcccagaccagcagtagcaagccaataatgacgccggccacgcacataatcaccaacggcattacgctgtagcccacggccagcagaatcagcacgacaatcaacgccacaatccatagaccggtaccgatggcaaacaccttacgcagatccacccgtacgggcttgggtgcgggtttgcggacggcagggtcaatgagaggcgcgaacttcatactcatgcactgtagtaagagtagggaggggcgtcaaacatccctccctacgatttattcaatcggcatcagttgagaccgatcaatgtgcatggcatatatggtcggcaatgcggggcataggctgccatcacaggtgctcgaccacgtagtcgacgcacttggtgaaggccatgacatcagccggttccaccgaggggaacacgccaacgcgcagctggttgcggcccagcttgcggtagccggcggcgtccacaatgccgttctcgcgcaggatggacagtacctgagaggcctggactcgctcgtccagatcaatggtgaccacggcgttcgagcgtgcgtccgcatcgacgacgaacggagcggcgtattcggagcgctcggcccacgagtacaggatggatgcggacttggcgcaacgtgtggtggcccaggcgaggccgccgttgttgttgagccagcgaatctggttttccatcatgatcagggtggccacggcgggcgtattcagggtctgatccttgcgggagttgttcagtgccgtggtcagcgagaggaacggcggcacccagcgatgtgcgccttccagatgagcgcttgattcgacgcctgccgcacgatcgatagcttcgggggagaggatggcgacccacagaccgccatcggcaccgaaggccttctgcggtgagaagtagtagacgtcggtctggctgatgtccacaggcaaagcgccggctgcgctggtgccgtcgatgacggtcaaggcaccagcttcacgacttccggccacgcggcgaatcggggcggccacaccagtggaggtctcgttgtgagcccagcaatatgtgtccacgccctcggtgagctcaggcagacggtaagtgcccggctcgccggggaacagcaccgggtcttcaaggaagggtgcgttcgcggcggacgcggcgaacttggcactgaacgagccatacgtgccgaatgcggcgcgacgggtgatcagcgaagcgcaggcaatctcccagaacgcgctggcgccaccgttgccaagcgccacctcatacccttcaggcaggtggaagaactcgcgcagaccttcacgaatcgaagcgaccagttgcttgactggtgcctgacgatgtgatgtgccaagcagggtggtggcgccggcatcgagcgcggcgatctgttcggggcggattttgctgggaccggagccgaagcgaccatcttcgggcttcagcgactcgggaatactcagtgtgatagtcatggtttcaagggtagaccagtgttggggaatatcgcggataatgctcggtgtacgggattactgcggggctactgcggaattccggggtgccgggcggcagtggtggcaatgcggaatgcagtgcagaatgtacgcagcacatcatggctacggtgtgtcggaatgacatgagttagtgattcttccgataaccggatagtgaggttcgtgaacgggcggaaacaaggcagtttttcacccggccgcacggttacgtaaatcgtttgacacaccctgatggtgggggatcacattgaggattgacctctgttcgttgtacagtactcaattgtgacggtcatacgaggtcgtcgaaatgaccccgccgaacccatccaaggagttaacgtagtatgaagcatgcttcgcataaagcgaccacggtctcgcgccagaagttcagcttagcgaaggcattgtttgcctccggcaagggttctcattccgttcgtgccgtgcgcgcggtgcaatccgctggtagcgacgctgttgttttggggcttgatccggccattgccgagaagatcaacgaaatcgctccccagactcgtcgttccattcgtgaggccgctcgtgccgctgaacgccgtagccatattcttgcctcggcctcactggccgctctggtcggcacggccgcaggtgctctcgcgttttccaacaatgaagacgccacgaactcgttcgtggctgatccggccacgacgaccacgcagattaagcgcatcagcgatgtgactgcggcttctcgttccgaagcgcgtactgatttgagttcatcctccgttaccgcacagtccaccaatgaaggcggttgggggctgagcaattcagacagcaccttggacgccaagctgatgaatcgcaataatgcgaacaatcctgtggtgtcggctctcatggatgccgatggcgatgctgtgccggctggcttcaacccgaaccatgccgttggcaccaactccaacaactatccgtggggtcagtgcacgtggtacgcgtaccagcgtcgtgccgaactgggcctgccttccagcggcaacttcggcaatggtggcgcgtgggcggcgtcagcttccgctctgggctattgggtggacaacactcctcgccatgtcggtgatgctgtggtgttcgctcctggccaggccgatgccgatggcgcgtacggccatgttgccgttctggaaaagatcaatgccgacggctccattgagatctccgaatccaatgccaagggattgggtgtgatttcgacccgtacgttcagcgccgccgaagccggtaagttccagtacgttcactactgattcatttcattggcttacattcggtgattactgttcggatgtgacgtcgccctatcggcaatcgttcgcgcgagatggcatttcaagtgttgcggctgcgtattagtccgaactgacctgtgccgacacgccgatatatcccaatagctccggggtgttttatttcttccatcctgtacgagttaatgcgcaccgtgtagggtgatggttctatgaagaccaaaactgtagcttcttccattgttgccgcgattgtctcctgtgcttgcttgtttatgtttgttcctacagcaactgcagctgagggcgttactgtgacttccaccaagtccttcccctcgtatacccaggtgcgcaaagatctgacgactgaagccactgccacgagcgttgaggacaatgctgattggggcggcattgagaacctcgatgtgccgcagacggaatctcaggcggaaaaggatgccgcagcggccaagaaggctgccgaagaggaggccgagaagcaggcggaggtcgaggctcaggcgacccaggagcaggccaacgccgcgagccgtaatgagtctcgctcttctgttacttattccgatgccagtggttcggtttccgctggtgccggtgcctctatcgaccgtgcgtattctttgatcggacagagcatggactgcaccgcattggtcagtcaagcgttggcggcccgtggcattaacttccacggttggcctgaagagtacgtcaatgttcctggtggccacgtagtcacagacggatccctgcagccgggcgatattctgatttatgccaacaccggtggatggaacggtggtgcacactacgatcatgtggcgttgtatgtcggcaacggtcaggcggtccatggtggatggaatggctatagcgtggctctcgctagtgccatgaccgaaaagctcaccatcgtggtgcgtatcccgtgatgcagtcttattgattgatttattgcaggcctcggatgccgatcggtatccgaggcctgttgcgttctcctgccgaatgatgcacccgcgacatcatcttcgaaatgctattcctgttatgaaatcgacccatgtgtgctagtgtatggcgttgatgatgagcgttaagactattatttccacatcagtggcgattatcgccacgggtgccatgtttgcgtgcgtagccccgtttgcctctgccgattccgcgcagacgagtgctgtggtgtcctcacgttctttcccgaaggcgagttcggtgaagaagaatttgttcgccgaatccacctccacctcggttgatgagaactctaaatggggtggcatcgagactcttgatgtgccacagaccgagtctcagggcgagaaggaagctgctgcagcggcggcggctcagaaagccgctgatgaagctgctgcagcccagtccgctgctgctgcggcagccagccgctctgaacagcgtgcgtcgattccacaggttgacttgggtaaaatgactggcactggcactggcgctgagcttgctagcttctcactgaagttccaaggctatccgtatgttgccggcggcaacactccggcaggatgggattgctccggttttgtgcagtacgtcttctcccagtttggcatctccctgcctcgtacctctggtgctcaagccaccgtgggtactccggtcgcaagcttggcggatgccaagccgggtgacattcttgcgaatggtactcatgcggccatttacatcggtaacggacaggtgatgaatgctatgaacccggtgcagggaacggcagtaagcgacgtttccgtattcggtggagctggatattccattcgccgcgtgatgtgacaagaattatgcggtaagcgaattcgtattaaggcacgtcctttggggtgtgcctttttcgtatacgcggatttctttttgagcggaggataccggccaaaccgagtgtcgcggggtattgttgagatacgcggtattcgtgccgcaataacttcaaggaggtcgtcatgattaacgacaaggctattctcgtcggcgttgacgggtcgcatgccagttacaaggcaacatggtgggccgcgaattatgcaaagcacgcggggctgacgctgcagattgtctgcgcatattccctgccgagctatgccgccgtttcgttcgatgccacttacacggcgatgggggacgataacgccgcgcattccgatgctcaggagattctgtccaaggccaaggccatcgcagacgagcagggcgtcgaagccgccacactgattgttaccggagatccggcatcggtgttcgtcgaattgtctcgtaactacaatctgatcgtcattggcaaccgtggcaagggcggtctggccgagcgcctgctgggcactacgtcctcatcgctgccggcatatgcttactgcccgattgtggtggtgccgtacaccgatgatgacggtaacctgatgcacctgaacaacacgatcaccaaggtggccgtcggctccgacgaatccaagtggggtctgaaggcgctggacattgccgccgacttcgccacgtgctggggtgcggaactggacgtgatttccgctgtgccgaacctgaagggtgtggacggcgaggacgccgtcatggagtcctacaaggacgatcttgaggtgcgcatcaagccgttgcaggaatcgcatcctgatctgaagatcaacaagcagatcgtttccggcccggccgtgagcgccctgaccaaggccagctacgatcacgatgtggttgttgtcggctcccgtggtcgcggcggcttcactggcttgctgctgggctccaccagccagggcctgctgcagcatgcggtcggcccggtgtacgtggtgccacgcaagtatgttgaggccgcggaatcgcgtctcgacaccgtgccgagctcgcccgccgaagtgcctaccaagtcgctggaggagattgccggcgtcgaggagattccggtgtccgcagccgagcctgaagtcgcccagcagatcgaaaagaccatcgatcccgatcgccagtaaagtccgaatatacggaaagaggctcccgccagggagcctcttcaatttatatcccgtctcagtgcttgacggtgacgttcatgcgcaccggggtctcctgcacgtaggtgtgcttgaccgtgcaacccttgtcgatatggcgggtgacgcgctccttgagcttgtcggcatcctcctcggacagaccggcgtcggaagcatcaatcaccacctgctcctcgaaaccggtgtaggcgtcattttccgggtcgtacgtgccatccaccacaatcttggcacccttgccctcacccagcgtatgttcgatggcgaactggctggacagcgcggcgcaaccggccagcgcgaccttcatcagatcgcccggcgtgaactggccacgatccttgccgaacttaatgtgtgcgccatcgtcgctgaacgcatcccacgaaccgtccttgttacgctcaacccacagtcgcttacccatagctgctcctttattttcagccgccggcgatctggcccatcgccatgccagcgggggagcgcggcacctggccgctctcccgcatcatcggacttctctattatgcccctaagctacactggtgcacatggctttgaccgaagaacaactcgcagatattcgctcccgtatccccgcacgtcccgaaacggacattccgatgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacggcaagctaagctgccagctgtaccagcgttcctgcgacatgttcctcggcgtgccgttcaatatcgcctcctactcgctgctcaccatgatgatggcgcagcaggccgggctcaagccgggcgaattcgtctggaccggcggcgactgccatgtttatgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctgatgctgattaccgtttcgtggacagcgaatactgtgaaggtgacggcccccgagtcttcgctgtccactacactaaggcccagttccgcaatccaggaggagtaagcgaaatggagcatgacagtagccgtagcggctatcacgaacccgagcccggatctgccgggctgtctgccactgaagaagactggggtgacgattatcccaagaccttctcggtgaatcttatctgggccgaagcccgtgacaaggaaggtcgcgccggtgccatcggcctcaatggtggcatgccttggcactgtgccgaggatatgaagcatttcaaggagctgaccgtctcccatccggtgattatgggtcgtaagacctgggaatcgctggggggcaagtaccggccgctgcccaaccgcgacaacatcgtcgtttcccacgatccgatgtaccgtgcgccgggggccactgtggtcaccagtcttgacgacgcgctcgatatggcccgtcaggaggcgattccggacgacggtctggaccgttcggagatttggatcatcggcggcgcccagttgttcgccgaggctttgccgttcgcggacaaagcctatgtgactgatctggccgccaccgtggatgccgacagctacgcgcccgatatggcgtcgctggtcgaggccgggatgtggagggaagccgaagtgggcgagtggcatacgcccgccaaggaggagtccggcatcgattcctatcgtttccgtatcttggccaaaaccaagtaagcatgcgaatccggcttatgccctttatagcggcatgagccggattcatattcattcgaccccaacaatacagtcgggccgtgtgcggcccggtgaagcccgattgaggattgattcaaagctatgagcaatacccagccctacaccgtaatgaccgtctgcaccggcaatatctgccgttcgcctatgggtgagatcattctgcgtcacttctttaatgagcgcggtcttggcgaccaggtgaacgtggaatccagcggtgtgtccgacgaggagtggagccacccgatcgacccgcgtgccgtgcgcgtgctacgcgaacgtggctatggtgatgagattccgcgtgaccacttcgcacaccgcatctcgcgtgaggaaatcgaccgtaccgacctgttcctgccgatgaccgcctcccacatgcgcgccctgctgcgcatgctgccggccggcaagcgcgccgaagtgcacatgtaccgcagcttcgacccgaatctgcccaagtcgaagcccggccgcgaagatcagatcgatctggtggacccgtggtacggcggcaagcacgagttcgaggtcgccatcgaccagattgaggaagtcgccccgtacatcgtcgattgggtggcgaagcagctgtaggaatcggcctgtggccgatgctgtgtgtttcgcagtcttacgactgcgggtctctacctccgtcaccgcttcgcggtgccgcctccctcgtcagaggaaggtacagaagattacctccctctgtaagggaggtgctgagcatagcgaagcggagggagagactaacgagtcgggtgcctcagaacaccagttgcaccagcaacatatatacaattgtgccgccggcgattgaaagcagcatattgcgtttccatacgtgtagcagcacgatgacggtgcaggcgatgagttccggaaggccgtgtgaaccggtcagaatcggggtgttgcgcagtgcgtataccaccagtagaccggtcatcgcatagggcaggacctggccgaaatactcgatgatgcgcggcggctgcttggactcgggaaacaccagaaacggcagaaaacgggtgcacatcgtgcccagcaccaccgtcacgatagtgattgcgccttgccagatggtcatcgtcatcgcgtctgtccttccttctgctggtccgctgcgtggctcatggcatggtctgccgtggcttccggggcgtcggcggccggccgcaacacgtccagatgcgggcgtagcgcgacgaacagtatcagcatggcgatcattgagggaatcatgaaatcattggccccgaatatcagcaggcaggccagtgatgtcagcacaccgatgacggcggacagtcgctcgcgatgcttgccgtcgagccactgatcgaggaagatcaccagaaacagcgcggtcagtacgaaatcaagaccgtcggtattgaacggcagatgcgcgccgatcagcccgcccagtgtggcgccggtcacccaatacagctgattgcacagcgtaacccagaagtagaaccagccacggtcgatgccggcggggattttcgcggtggagttgatggcaaaagtctcgtcgcacataccgaaaatcaggtatgggcgcttccagccgagccctttgaatttgccgagcatggatagtccataaaacaggtgacgggcgttgaccatcagggccagcagaaagccggcgagcgggttgaacgcggagagcagcagattcaccgtgacgaattccattgaaccggcgaagatgaacgcgctcatacacatcggccatacgaaggagaagcctttggtgcccatgagaatgccatacgaggcgccgagaaacaggaaccccaggcaaatcggtatggtcagcggaaacgccgctttgagcgccggcagccaggcgttggtgttggtgttggcggtgtctgccatgtggatgatgttctccttgtacaactggtctgccggccgatgttcgccgatgatgccatatgcggttatacacgcatggtgtcgataaacggggtgagggtggcgtcgggaccctgtgcgcgaagtcacagtgtggaggatgtcacatcgtctacggtgggatagtccttgtggcgggcgcgaacacgtgctgagatgaaaccatgagcacatatcaagcgggccgaatgctttcagacctggtcccgcgaatacgaaaagacctcggtcgctatgaccggggtctttagtgaagtacccccagagagagtcgaactctcgttgtcagattgaaagtctggtgtcctaaccgttagacgatgggggcgaacaactcgaattactttacgggaggttgttcggttatgcaaatcgacggcatttcggcgtgtcgcaatcagttcagggtaacggcctgataggtgaagtcatgaatcacgcggccggcggccaggcccttcttctcgaagttggtgagcacgcggccctcgaaccgctcggattcggtgaagtcggcgtgcggcatatcggcggccatgtcggcattgcccttgcccacgtgctccagcggcaggctgacggttacgctgcccaggttcttccagccatcgaggccgtccatcacctcgtgcacgtgcagggcatagtcctcgatgtcggtggcgatacgccagacgccgtctgtgaccagcgcgcgatgaatgtcgccggccatggccttctgcacgatgcggcgcttgtggtgcttcttcttgggccaagggtcggggaagaaggtccatacctcggccacggtgccggccgcggtcaccttgaacagctcgggcgcattgacctgggccacgcgaatgttggtcagcccctgcttgccggcgagcagcagcgtgtgggccacgccggggtcatagacctctagagcaaggaagttcgtctccgggtgggctgcggctgctgccaccacgttttctccctgcccggtgccgatttccacaatgagcggattatcgttgccccatgcggactccacgaacgcgcggtcgagcgtgacgccttcgcgcacgtccagcaggttgccggccgcaatatccaacagatatgtgccggcatagttgtcccatgcgcgctgcaggcgatcgtccaaacgtccggagcggcgtacgaaggagagcaccttgtgcagggggtgcgccggtgcctcggtgtggtctgtgcccatcgcggcgacgggatcgattgctgtggattcgggattggtcatatattcctcggattttccttgtgcgccgcaccgctgttcattcattaggtcgatttggcgttcattaggtaggtggtgtgcgataccaaccaccatatcaagccgtttacccggtgtccgtgcgggccggctccgggccgacctacctaatgaacgccaaatcgacctaatgaatgcagatattgccggacgacaccaccgttttgtgcgattatgttcgtgtgatatactcaaattgtttcaaaaggtaacaaagcggaccaaaagtgaacagccgctgaactccccacggccgacacttgcaacccgcacaaggaaaggtcagctatgacagttctcgtcaccggcggctgcggctacatcggcgctcatgtcgttcacgcactccatcaggccggcgaaaaggtcgttgtcgtcgacgatctgagctacggcaagcccactcgcatcgaaggctcccgcctgtacggcatggatatcgccgccccgggcgccggtgagcgtttggccgaaatcctcgatgccgaaggcgtcgactccgtgatccactttgccgctcgcaagcaggtcggcgaatccgtggagaagccgctgtggtactaccagcagaacatcaacggcatgctcaacgtgctcaccggcatgacccagtccaagaacgccaagaagctcgtcttctcctcttccgccgccacctatggtgtgccgccggtcgatgtggtgcctgaggacgtcgtcccgatgctgccgatcaacccctacggccagaccaagctgttcggcgagtggatggcacgcgcctgcgagcagccgttcggcatccgcttctgcgcgctgcgctacttcaacgtggccggctgcggtccggtggagcttgaggatccggccatcctgaacctcatcccgatgctgttcaatcgcctcaagcagggcaaggctcccgccatcttcggcgacgactacccgactccggacggcacctgcgtgcgcgactacatccacgtctccgacttggccgacgcccacatcgccgccctcaagtacctcgaccgtgacgagcgcaagtacgacgccttcaacgtcggcaccggcgaaggcacctccgtgcgccagatcgtcgacgaagtcaagaaggtcaccggtctgccgttcaccgaggctgtcatggcccgccgcgccggcgacccgccgcacctgatcggctccccgaagcgcatcaacgaggagatgggctggcatgccaagtacgacgtggaagacatcgtcaagtccgcgtgggatgcctggcaggccaaccccgaacaccacatcgacgtcgacacctggaagcaggctgactgagattgacggtcactttgcggtggatgccgcgaagcgtttccgtccataagggcgtggccggggttccggtcgcgcccttcgtcgttttgtggatgtttgtgacagacgtgttcgcgtgctggtgatagcaaaaaccttgaaattatgcggaacacgccgaagtttgcatgactggcgaatttcagtaatatatacatctgttgcctcacgcaagtgagaacaatggccccgtagctcagttggttagagcgccgccctgtcacggcggaggtcaccgttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggtacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggtcgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcgtccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggaatcgtcgctggaatcagctgcatcaacatccacaacggaatcagatacgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggctcctgcttgcgcggacggttggccaccacgtcgatatgcagatcgtcgaaagcaggcttggactgcacccacagctggcttggctcgggaggttcgatttcggaatgctcgccgcagccgtggtccaaggaaaccacgcggccgtcatccggactccacttgttggcgcacacgccgaacatacggtcgagctcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccttccaaggaatccacttgggcggcatcaacgcgtcctcagtggggatcaaggaggattcgttgacggtccaagagtcgatctcctcgtcgtgatacagcgtcaccgaccattgccatccttcgtagccacggatattcgcggcgaagcggaagtcagtgacgtgatcctcaagatcatatgaggtaacgaaatcccccacctgatcgctctcgccggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgttggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtaatgatctgcttggccaccgcctgcgtagtgaatgcctgaccgagcgtgatgccattggtatcgccataggtaggcagaatcggcaccgatacgataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcggaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcagttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcgagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttgctcactcggagcgggcttcacccgaagacagcttgacaacatcctttgcctgcgtgcctttgccggacgaagcgggcgtatactccacgcgatcgccttcgtacagcattttgaacttattggtgctgccgtcgtccttgatttccgcgtagtgcacgaaaaacgtcctcgccgccgtcgtccggctggataaacccgaaccccttcttggcaaggaagaacttcacggtaccttgtgccatatctggtctttcctttgttcccttgggcgtcgcgacacaaaacctatagggaacgtagaaagaaccgcatcgcgctccccctacctcgcgactagatgatgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcgggcggccgaattcgcatcagggcaaaggctgggaggaagtcaccgaggccgcgattcgtgcgttgaacgcgcgcacggacgccgacggcaagccccagccgctggtggcgattctctgggggcgtaatgcgcaaagcctcgagccattgctgaccaatgccttcattatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcgccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgatatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcgtccttggtgcgtttgggcgcctcgccgcgcgccaccatcgccttgacccgtatcggccaggcgaaggcgttgctgtccgggcgcgactatgtggtacccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaagatcgaggcccttggcactcagctgagcctgcctaccgtaaggaaggctttgggcgcgctggagggcgaacacgcatccgggcgtcgcggcggcagcggcgatgcgatggatgtgcatgcctatgagccaggcgacgaatcccgtcttatcgattggaagaccagcgcccgccaaggccgccccatggtggtcgagcgcgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagtatcacccgcgtgccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcgtcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcgagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgtgtgggcttgcatacgacgtacgcttatgctgctcatcgtcgcggtgatggtactgactcccagcgtggtatcgtctaccacctcacaggccatcaatgccaccgacgtcattgtggcggtggataccaccgggtcgatggcggtggccgacgccacatacgggtccgagaagaccattacccgcatcgatgccgcacgccaggccgtgcatgatgtgaccgccgcttatccggacgccagtttcgcggcgttacggttcggtgcttcggggacgcttgatgtgccgctgaccccggatgcgccggccatcgataattgggccaacacgttggcggtggaagccacatccgtgtcggcgggctccagtctggatgctccgatcgatcaattgctgctgaccgtgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcgtcgaagcagtggcgcatgaccaccacggtcagggaacgcacacgcaccacgccggtggtatggccgttggccattgcgttggcgatattgcttgccatggaagtcggtgcatggatcgcaacctcaaggagactgctgtgagaaacagtaacgaaatccacgagaacgatggctcggcgaatactcggatgcgggcgaagtgtccgctttgggcacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgacgcgcaattcgacgaggccgggcgaatgcgcacgcttctgttgccgcaagtcaaggacgccatcgacaccaatgcttcgatttcttccgagctgacaaagatcaccctgaaacaggccgaggcgcagaacagcggttccgattccgggcaagcccagtcggcacagcaatccgagaattcttcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggctaccaagccgtggtaagcagtcgttcacagttgttcttttttctcacaccctcacgggtcatggctttatcgcggctgtttcccggtttcggctgtcggctttggcatttatccaattttcgataggccatggctgatccaaggtatgtccaaacaggctatttgtggataatcgttacgactatgcacaacacttggggataacttcacccaaaatcggcaagctagaaccacattggtcgttccggctggacaagcatgagtcttgtccttttagctggatatatgaatacctacaccagcaacccagcacccatcgatcccaccggcggctttgccggcaatacggtgacgccgttcgattacggcacttgcccttgccatgcggcggtacagcgtagtcgcgacctcgtgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcgtcatgagcgagcacgattactggcaagtggaatcgtccgtttacggcggagtgggatatgcgccagccactcttgaagaatatgccgccatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggcgggtgttgccgctgtggcggcgggcggctttctggccggctggactattgacggcaaaccgaacccggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgttgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggtctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgatggacttatgattccccatcccacgtcataacgaaatcgacaacaacctcgcggacattatttgcaaagaagcagaagccaaactcgggaaaggctggtatcagcagtgaaaacatatcaggtcatcgttcgtcctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcagcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgctagcatgcccgaaaccccctctatcagcgcaacattcccgggaaagtggcgcgcaaagagtgtcaggcgcgtcgctcgatgagtgcgcggccggatgcgaggcggtcgagcacaccggttttggcgatggccagcatcagataccaggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatgatgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacactcggcaaggagctcgccgtctacgtctaccgtctgaaccgtcagctcaagcacatcgaaaaccaggagtacctgggcaagatcaacggcgcgaccggcacgttcggtgcccacttggccgcatgcccggatgtcgactggatcgctgtctcccgcgagttcgtcacgaaccgcatgggcctgacctggaacccgctgaccacgcagatcgaaagccacgactggcaggccgagctgtactccaccgtctcccacgccaaccgcatcatgcacaacctgtgcgtggacgtgtggatgtacatctcccgcggcgtgttcgcccaggtgccggtcaagggtgccactggttcctccaccatgccgcacaaggtcaacccgattcgtttcgagaacgccgaagccaacttcgagatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggtggccttgagtccatccacccgaacacccacgtcatcgagcgtgagctggatgagaactgggaggtgcttggcgagccgatccagaccgccatgcgcgcctgcgagctcaagggcctgccgggcatggataagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcggccgctgagataggcgcgatgcgagtctctcgagtccctcgagtccctcgaatccttcgcatccaccacactactgcgctgagtcacaaaccgaaccgcaaactgaaccgaacaaggacaggcgtcaggtgaccatttcatgactactgaacaggatcagtccactacggaagatcgcccgaacaaggcgacctcctccactaccgaccggccgatcgcctctggtgacggccggtcggccagttttgctgtcagcggaccggacagcccggcaaccgacgacagcaacgattccggaccatacatcgacgacatcgctccgcgccgcacgcgcgacttcggcgacctgacccgagccggtctgtcgctattgatggccgccgtggtcatggtgttcgccgtgtatctgggcggcatgacgcgcggcgtcgaatccgacgcgcataccgccgcccaagccatcaactggctggctgctttcccctccaccgtactgacgcagctggccaccacggtcatcgtagttatcgtgctcgctcagttgctcttggcccgcgaatggctgcaagctgcggtgtccgcgctggccatgtttgccggatacggcattgtgtgggtcatatcgacggcaatcagcagtctgaacgatttcaccctgccaatggcactggtctcagccgccacctcatacggctccgggctgttgcccgacatctacgccggcatggcgtccttcctgaccgccgccgggccacgccgtacccgctccacggtcaaatggagttggaatatcctgtatgccatcgccgcggtgatggtggtgctttcgtggcattcggttaccggcatgctggtttcgatggccgccggtcgcacggtgggcatgctgatccgattcgtggtcggcacgcagaataaaggcgtgtggggcaaagatctcgtcgcagtgctctcaagcatcggattggaaaccacctcactcatccggcatcaggagcccggaatcagccatggctcattgtctgccacgttggatgacgatttggcggaaggttcgcgcatctacgatgtgaagaccgcgaataaccgtcgttttatcgtttccgtcatcgacgcgcaaacccataccgtcggctatctgaagcaactctgggattgggtgcgttttaccagcgtgtccattcgacgcgatcgttccgtgcgcgacgccgttcagcatcactttgccatgctgctcggcctgcacaatatcaaactgcccgcgcccgccccctacggcatcgccgatacggacgagtccgcgattctggtgctggatgcgcacaccatcgagttgcccgccaacctgaacacgcttacccaggcggacgccgtagcgtatatgcgatatctgtccgtggcgaatcgccgtggatatacgcaccgacgcatcacgcctgatacgctcgcccggctcgaagatggcactgcggttatcgccggctggctgaatggcgacagcgcttccggcccggccaataccgcacttgacaaggttcagctactcgcgttgttcgccgcactgatcggcgtgaaaccggcagtcgcggccgcccgcgaagcttggggagacacgacgttgaccacgttggccccgttcattcagaaagtcgcggtcccctcccccacacgcgcattgggcacgtgggacaagcagctgctcaaggaactgcgagaccacatcaacaccataatcgatgaggagaccgccgaatccgccgagccggtgacgctggcccgcttctcctggcgttcgatgatcaccatgctgctggtcatcgtggctgtggtcgtggtcttcacccagctgaagcccgaggaaatcatcaccgcgctgaccaacgccaacccgttgatggcggtggtgacgctcgcgttcggtgcctgcggctggatcggctcgtcgatttcgctcggcgctctcatggatcgcaacagacgagataacacgggcgtgttcatgagtcaggttgccggcggctttgccacagtgtccatgccggccggcgtgggcccctcgttcgtcaacctgcagttcctgcgcaaatccggctatcgcaacaccccggccaccgcaatcatgagcgccacgctcgtggtgtattacgccgtgtacttctccatgctggtgttgattggcctgttcaccggccgcaatatgttctccggcgcgataccgacgaatacgttggtccttgtgctgggcgtggtggttgtggtgctgtccattgcgatgatgattccgccgttgcgccactgggtgacccgtcgtcttatgccgctggccaagacgtatatcaaccagctgctggacgtgctttcccagccccgacagctcacagtcagttgcctgggcgcgctgttccagaacgcgaccactgggctcgctttctgggcggccctgcaagcgttcggccattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgcattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgacctcgtttcgaagatcgcccagaagtccaacctgaccaaggctcaggccgaggctgctgttaacgccttccaggatgtgttcgtcgaggccatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagacggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggggcggtcagggtcaggtgggtccagtcggcggagaactgggctccggcgttcagggccgattccacgaatcgtccgcgcaaggccgcgcgggtgtcggccggcggattatgcacggcatattccacatcgtcggcggtcagcagttcgcgcagctggttgcgggaagtcagcgaaccatacaggcggccgttggcgatgtcgtgataatcgagttcgagctgttccatctgggcgaaggtgacgtccgggcgacggcgtttgagcgcgtcgaacagacgcttcttggcggcccagtctacgcggtcggcgagcgcatcgtatgcaccacgctccagcgcgtccagaacgcggctccactcccccataatcgtgtcgatcgtggtggccggcagcgaacttgccagcgcatcgacatgggtttcgatgaaggccttgaccgccgcataataccggcgctgcagacccagtgcggacacggattcgcctgattcgagcgtcagttcggcgcgcggattgtcaaggaatcgactgaccgtgcgattggcggcagccggatcagcaaaggcatactgctcgaatccggacggaacgccatggcggaaggcgtcttcgatcgcgcacagcacaaggtgcgtgacggcaagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgagccagggcctcgcgcgggtcgcgcgcttcggcggtggcgtattcggggtgggatccgacgtccagatacagacgtgagccattggccagatacgtgttggtggagcgggaacgggagacgatgggctggaacatggtcatcgccacctggccggcgtccacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggcctgcgtggtggcgagggcgtcgtcttcctgggtcgcggcctgctgtgcttgaggttgttcgaattgttgtggcatgttgtcttctttttgggctgtcaaactcccctcagtcagccttcggccgacggctcccctcacccgaggggatccggaggagtcaaaaaattatcgctggttgatggagtcgagccacggatactgctgcaggtaatgctgcagttcgcggatgatgagtccattggaggccactacatcgttatcgtgacgccagtggatgcgttcgccgtcccaacggctcagcgtgccctgtgcctcccagaccactacggtgccggcggcgatgcccgcgatatcccacacgtgcagcatcggctcgaagtaggcgtcataggtgccgtcggccactttgcacaggtcgagcgagacggggcccacgcgcttgatgtcggccgggcgtccggcgagcgaggaggccacgtcgagcgcacgctgcgattcgctggggatgaaggacatgccgtagctcagcacagaaccatccagcgaggaggtcatcgacggcacgaccttgtcgcgcttctcgccgaccgcggttttgtggatgcgcacggcacccgctcccctggcggccaggtaggtcaggccgagggccggggcgtgcacgatgccgatgatcggcttgggctcgttgtccgggccgaattcgaacagggcggcggtcaccgtccattcgctcatgcgacgtacgtagttgatcacaccgtcgatcttgccgatgtaccagtaacgctggccagggcggctttcggcggggcgggtggtccagaagccgtcgaagtgggcgatgtcggcgattctggcgctcatgaagcgcatgatcttgttgtccacttcaagcttgtagcgggggccacggtccgcgttctcggtgctcggctgggcgaggttacgcggattgagttggtcgtggagggcatgctggccggcttcttcgagcaggccggcgactttgagcgcaaggttgcgcaggtcctgtggggtctcttcgcgtgtttcttccatagctaccaagtctatcgttcggcgttgatggccagcgacttcagcagatcgatggcgtgttcggctgaattgagttcggtttcgcagtgcgccttggtgaaggcgagcggatcggagatgtcgagggagaacaggtgatggtcggtagcggccatatggccggcattgccgtagaattcgaccgcctcgccctcgtctgcggcgcgcgggtcgcgaacagtgagtcgggaccagctggcggcggccacctcatcgccgaattgcgccacgagttttgccctgagccaggcgcgggtgtcttccggcggttcggtggtggcgcgtgcgatgtcggcggcgctcaccacccgttcggtgcggggttcgagtttggtgaagatgctgtccgcggggtcgagcgccgcccatttcaggtcgatgaccttcagtcgcggatcattccatccgttggccacgccgggtgcggacgttgtggtgattttgcggcgcagtttttcgagcagctgccatttgagcagccattcgatgcggctggcctcgccggtcatggccagacgttcgtcatcgtcggcggcatggcggatggaggcgcagtcgatgagcgcctgctgccacatcgccataatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcgtgggagacggtgtgcatggcttcgaccgggtcggccagttcgagttcgtcgaggaaggcgttcagatcgaatccggcttcgtccgcgtgttcgagcagccacagcagcatgcttgtggtgccgagtttcagggcctgcggtacctccatacggttggcgtcgccgacgatgacgtgcaggcggcggtattcgtcggtggagtgggattcgtcgcgcgtgttgataatcgggcgttcgaaggtggtttgcaggccgactttggcgtggatgtagtcggcgcgctggctgagctgatagccggggatttcgctgttctcgccgattcctacgcggccggagccggcgtagatctggcgggtgacgaagtggagggtcatcaggcgcgtgactaggtcaaatggcactgagcgggccatcatatagttctcatgcgtgccccagcaggagcccttgccgtccacattgttgcgatgcagggcgatgggggtgccggtttgtgtgcgggcgcgttcggtggcggcctgcatgatgaggtctccggcacggtcatagcggaccgcttcgaacgggtcggtggtttccggtgccgagtattcgggatgggcgtggtccacgtagacgcggccaccgttgggagcgatcacgttggtgatgttgagttgtggggcgtcggtgagcatgtccgggcgggcggcggcgcgttcgagtcgggtgccgcgcgcgtcgttgaccgggtcctcctgccggtagtcccagcggatggatttgctgtggctgtccgcggcgccgttcaccacgtcgaaggacagttgcaccgggttgtagcggtccggggtgttcagggataccgcgtattcggtttcggtgcccatcactcgtttgacggtcatgtagtgctccttgagcttgagctattcggcggtgcggatgcggcggatcgggtccatgccgttgatgcgcgaccattgttcggggtccacgtcagccatggaatcgcgggtctcgcggtattcgtcttccacggcggcggcgagcaacggcacggtgagtgccacgtccgagccggtttcgatggattccttgaccgctcgggtcttggcccggtccacgatgttcttgagcatcgcgccggagaccacatcggccaggaacaacgcatgccactggccgttctcctcctgcacgtcgcacagatggcggcgttcggaggctccgtagatgtcatgcaccagcacggcggacaaggcgtgcgcgtcgacgccatcttccagaggcaggtcgtcggtgaggtaatggtccacgatggcgatggcctgattggctttgggccgaccaacgcgaatcttgacgtcgagacgccccggtcgtagcacggccggatcgatcatgtccacacggttggatgcgccgatcaccatcacattgtcgagtgattccacgccgtcgagttcggagaggaactggggcacgatcgtggtctccacgtcggaggagacgccggagccgcgggtgcgcagcagcgaatccatttcgtcgatgaacacaaccaccggattgccgtccgcggcgcgttcacgggcacgctggaagatcaggcgaatcagccgttcggattcgccgacgtatttgttgagcagttccggccccttgacggacaggaacacgcccttgacatgggtttcggccgggctgatcgagccgtcgccattcgtatcgtaaccaccctcgcacagggcgttcgccacggccttggcgatcatcgtcttgccgttgccgggcgggccgtacagcagcacgcccttcggcggcttcagatcgtagcgctcaaacagcgcacgatgctggaacggcagttggacggcgtccctgatacgaccaatctcactatccaagccgccgatgtcggcgaacgtgacgtccggggtctcctccagcaccagatccttgtcgccctcggcgggcagcgcttcgatggcgaggcggacggacggatcgacgataatgcggtcgccctgattgatgcccgcatacgcgagcgcgccggaacggcggatgagcacgggattgccggaggcgtcggtaacgatcagtcgaccgtcgtcaagtacctgcttgacactgcgaatctggcccacggtgtcagcatcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattttcggcaacttatggcagtcggcagaccctattcgttgccgtcggcggatttcctgttacgtataacagtacgcacttttcgcaccacgaaccatacgatgaccacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcacccagtacggagccgatggtggcccagatgattgcgcccggcagactcagggtgccgcgtgcggcggtgaagccggagagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggtgtggggtcggttgcaagaatagtggcggctgccatggaaaaactcatagagggcattgtcccaaggttttccaagaatcagaagcatgacgcaagaagatgtgcattttattgacaagtccgccgagagcgaagttgggagcccggctggttctgcggtttctgtgccgacgctgagcgagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgatgcgctgcgcgcacgagtggccctgttggagggcctgccgatctccgtgttcgacacggtgcatgacaagctgcatttcaccaagggtgcgctggagcttatcgacacgctgcatgaacacggttggaagatcggcgtggtgtccggcggcttccatgaagtggtcgatatgctggcggccgaaggccatatcgactattggatcgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtctgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcggcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcggtcagagggtcagcggtgtgatttgggcacgcaccgataccagtgatacgccgcgctcttcgattcgctatatcgagcgagtgctaagccccgatgtactggttcccgcttcgatgcgcgaggatatcggtctggttgccaaagcctatggcggcacacgggccaatattctgcgtttcgccgtgccaccgcgcgtggccaaggtggagaccgagcagcggttggccgcgtcgttccgtcggccggtcggcggctcattgccggataatacgcaaggcggttttgccgggcgtggcaccaatcccgatgggaccaaacctgctggctctacctttgccgttgctagcaccgtttcggagggagctgcgcaggggtatcgtcgtctgaccgccaattacgccgatgtcaatgtgcttcatgacgcgcttaccggtcaacgtttccaatcttttgtgtttgattcgttgcccggtgcacaggagtggcaacgaaacatggcatggatggtggccactgcgttgagtgccggtaaggctgccgtagttgaattgcccaccatgcgcgaggtcgaagacctgatgcatatgctacgcaattatggactcaaaccatttgccccggttccaaccggcggatggatgggcgatgtggccgtgctcaatgcgaagaccatgcctgcggccgaccggtaccgcacgtatctggctgtggcgttgggccaggtgaaggtggtgatcggcacccgcgcggtgatgtatgcgccggttgaaggcccggcactgttcgccattctggaggatgccgcctatcagaacatggacggtatgatgccgtatccacaggctcgcggcgtgatgcggttgcgcgccaagtcccatggcggcgtattcgtggccatggccaatgcgcgcactccgcaaagtcagtgggaaaacaccggtccaggtacggtggaaactccggtgagcggctattccaccgcgattcatccgcttgcctcgccactgaaggatgcgacgccttgggtgcgttggctcaatcgcgatgagcttgcgcgtctcgctgacccgtccatcggggcgcgcgtgccgcatacggccgtccgcgtgctatctaaggctttggaaagtggccccgtgctgctatccattccgcaagacaatgtcagtgagaccttgagctgtgcgaaatgccatcgtcaggtgcgttgtgccaagtgttccggaccgttgcaactgccggccgaccgccgggattctacaccgcgatgccgctggtgtggggctgccgccatcaactggaagtgcccgggctgtgggcatgaacgtatgcgcgtggtgcgtgtgggggctgccggcactgcggcggagctggctggattgttccgtggcgtgccagtagttttgtccagcaagacgcagggtctggtgcgcgatgtagcttgccagccgatgattgtcatcgccactcccggtttcgaaccgcgcgtgcgtccggtcagtgccgagcagggatcggctggccatgagtatcgtgccgtggccgtgctcgacgcttggaccagcttgtatgcgttgggcgtggatgctcggttggatacgttgaccgcgtggatgcgtgcgatgtcgttgtgcgcgccgcgttcccgtggcggccaggcgttgattctcggcgagaccgacccggccatcgcccaatcgctgatgctctgggattcgaggattcttgcagccaaggatctcgaggagcgtgtggagaccggtatgccgccggccgtggccgccgcctgcgtgtggggccgccgtgatgcggtgatgacgctgatgcagcgtatcggcgccctgggcggcgattggacggcctgcggcgagctgcccggcatgttgggaccggtgccgatcgcgcaaccggacacggttgatgccagggagctcgaagccacggccgaccgggtgaaggcagtaatccgtgtgccacagagtcggcgagccgaactggcggcccgactgcaccgggaaaccgctcgtcatgtagcgtcccgcgagcccggcgagcttcgcttccgagtagatcccaaagatctgatctaatcgtctccaacacgtgaaacgatgattacagaacgaacatcgctataaggaggacaccatgaagggttggcccggagagccggatatggattacgacgtgctggtcgcggacggcgaagccgccgcgaacgccggcaagccgatcaccgacgtgatcttcgatttcggcaacgtgctgatttactgggatccagcggccgtgctcatcccccgctacagccagaagaccatcgacgaattcctcgacaacgacatctccggcttctacgatgtcaacgacctgatggacggcggcaccagcaccgacgaggccatcgccatcatacgccgtgacaggggcgataagtgggcggacatcctcgactactacatcaagaacttccgcgactccctgaccggcatcgtgccgggcgcacgcgtgctggtcaatgacctgaaggccgccggtattggcgtgtggggcctgagcaactgggaatccagccttttccacgtggccgaggaacagtgcgatattctgcagcagcttgatggcaagctcgtctccggtttcgtcaagctgcgcaagccgcacaaggaaatctacgaggccgcgctcaatcagttcggtatcaaggccgatggcgcgttgttcatcgacgacaaggccatgaacatcgtcggttcgaatgcggccggcatccgtggcgtgcgtttccaggatccggtcaagctgcgtgaactgctcatcgccaatggcgtgaacattccggccgtgcagtgagcatcgacgttttaaggaggaccatgctcaaactcgtgttcgccggcacccccgatgtagcggtgccctcgctcaaggcctttgccgccgatccacgttttgatgtggtcggcgtcatcacccgccccgacgcgcctaccggccgcggccgcaagctcacgcccagcccggtcaaggcgacggctctggagctcgggttgcccgtcatcgatctcaaaccccgctcccccgaattcatggaagcgctgaacaacctgcatgcggatatcgccgcggtcatcgcctatggcaatatcctgcctaagaacgtactcgacgcagtgcccatgggctggtacaacctgcatttctccaacttgccgaagtggcgtggcgccgctcccgcccagcgtgcgatttgggcgggcgacccgaccaccggcgccgacgtgttcaaggtcggcgagggtttggacgatggcccgatcgtcgcttccctgaccatcgagctgaccggccgtgagacctccggcgaactcctcgaccgtctggccgaggaaggcgcacccatgtatgtggatgccttggccgccgtgggtgaaggcactgccacattcaccgcgcaaccggccgaaggcctggaatacgcgcacaaaatcacggtggaagatgctcgtatcagctggacggacgaggccgaggccatcgaccgtcaggttcgcgcctgcacgccacatcctggggcatggaccgaactgtttgcggaggggccaatcgccgataatgacgagccggccgccaaacccctcaccctgcatattctcgccgcgcaaccggccgaccagtccaatcccaacactccggccgagcttcagcccggcgagctgaaggtgggcaagaagaacgtgtgggttggtaccggcagcacgccgctggaactcacccaagtcaaggcgcagggcaagaaggccatgcgcgccgccgactgggcccgaggcgcgcgcctctcccccgccgcctgcgtgcgataacaagcaatatcgctcccgcccggaagcacagcaaaaagcccggcatcttcgcgaggaagataccgggcttttcagctatgcaatcggcgatcagtcgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgataagcgccaccggtcccttattggcagcctcaggcgccatgtggccgatggccagaccggaggaaccgccggagtagcgaccgtcggtgagcatggcgacctgcttgccgatgcccttgcccttgacgaaggaggtcgggtacagcatttcctgcatgcccgggccacccttcgggccttcgtaacgaatcacaagcgccatgccgggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggcgcggtcacggtcgagcgaatcgaacagggtggtgtgggtccacggctccggggagatgatgtggccaggagcggccttgtacatctgctgggcttcctcggtgcaggtcgggcgcatgatgtcccaatcggccagcttggcttccagcgtcggatagtcgatggagtgcacgttggtgtgcagcttgccggcgcggtcgagctcgccgaggatgccggtgatgccgccggcgcgatgcacgtcggaaatctcccacttgccggacggcgaggccttgcagatgcacggcacggtgtgggaaatacgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgggcgatcttgacgacctgcttggcggcacgctcgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcgtaattgagcagttcctcatcggagacgttgtcgtcggcggtggcgtacatcacgtcgataaggtcggtgctcttgactgtgccgtcggcgagcaccgtggtgccggcctccatcgggccaccggagacgaacacggtcggaatgttgaggcgcagggctgccatcagcatgcccggcacgaccttgtcgcagttcgggatgcagatgagggcgtcggcgcagtgcgcgttgcactgatattcgacggtgtcggcgatgatgtcgcgggaaggcagggagtagagcatgccagtgtggcccatggcgatgccgtcatccacggccatcgtgttgaactcgcgcggaatgccgccggcttccttgatagcctcggaaacgatgcggccgaccttgttgaggtggacatggccgggcaggaactcatcgaacgagttggcgatggcgatgatgggcttcttgcccatgtcgtctccgctgacgcccgcagcacggtagagggctcgggcgcctgcaaagacgcgccctgacataatttttgcagatcgcatttcagtcatggttctattcaagcctttgcgagggacacgccatttgtcaagagtcgaatagtggaattttcaaaaacgtaacgtttctcacagtttttttttggaatacattcctctggcgagagtccggtatagggctgacagaagtccccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctccgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggttcgtaagtccggcgaagtgccgcacctgcgcccggacggcaagacccaggtgaccattgagtatgacgatgacgataagcccgttcgtctggacaccgtgctgatctccactcagcacgatcctgaggttacgcaggattggcttgctgttgagctgaagaagcacgtgattgacccggtgcttgatgaggtgctgggttccaaggtgccgcatgacaactaccgtcagctggtcaacccgactggttcgttcatcctgggcggcccggcggccgacgccggtctgaccggccgcaagatcatcgtcgacacctacggtggcgctgcccaccacggcggtggcgcgttctccggcaaggacccgtccaaggtcgatcgttccgccgcgtacgccacccgttgggttgcgaagaacatcgtggctgccggcctggcccacaaggtcgagatccaaatcgcctacgctattggcgttgccgacccggtatccgtcaacgtggagaccttcggcaccgagcaaggcgtgacgcgcggccagatcgccgccgccgtacgcaaggtcttcgacctgcgccccgccgccatcatcgacgagctcgacctgaagcgcccgatctacctgaagaccgccgcgtacggccacttcggccgtaccgacgttgagttcccgtgggagaagaccgacaaggtcgaggagctcaaggccgcgattgctgcggagtgatatcgactagtccaagaaggggtgttcccgctgatgccagcggaaacaccccttcttgtatatgagtctagtgctcgttcttcgtctcgctttgtccatccgtattgtcggtatcatcgatgtcgaatccgcccatgagtacgaaacgcttcaacatattggtggcgcgcatacgcaccttgaacaccggcaatgccttgtgatcatgctgctcaaagaaggcttttgcccgttgcacgtcaagcgaggaacgcagtgcatcgaaacgtccgaactcgttgatgttcgcctcgtctatacgtttggcaaggaattcctcgaccaccgatctgttgacacccaatcgatcgaccagtttgtcgacttgctcattcttctcgcgtgcagcatagcgagtgatgtaatcacgtagcgtaatgccggcttcaacctccacgtcgccacgctccacgtcatgcaggaacagttcggcgagtcgttgttcgtcccgcgagagcgcggcaaaggaacggtgtagctgcgcagacatctccgccaattccgggctattctccttgagcgccttcagccatttattgaagttggcattcatgtaatcggtatcgatgagtccggtattgatttcggtaagatagccatccaattcatatggcgcttcgggattattttttacgccatcatctgaatcaccaccgcagctgctattgccatagaacagttctttatagcgttgcgcaagaatgaggtatgtacgttcgtcgatttgaggacgcactacttcagactcgtcatgctcatcattgtcctcattcgcatcgtcagtatccgtactatcgaccttgtattctggggtactccagtcaaagccctgcactttcgcagcttcaaggtaccggttcagctccacgaactccttggcaaacttgcgcctagcctccaccgattccggcaactgcataaggtccgattccccgttatccgagaacacgtcaagaatttcccggtaccgcgtatccatggattttacgttcgccggcaatttctgcacgaacaggtcaagcggccgatcgcccgaatacagtttcaccgctgcttcaatgaagccatgcatggtgtgcggtttgcggtagtaacgaatgacaccgaacggcttgtccggtccgaacagacgattcgtgcgactgaatgcctggatgatgctttcgtagtcgataatcttgtcgagatacaacgtattcacccattttgagtcgaacccagtgagcatctggtctacgacaatgagcaaatcaagctgctggctgcggttcgttgctataccaccatacggactcttgtgcgacagtcgcgaagaaatatccttcttcatcgccggccatgtggggatgatgaactctttgccgaacgcctcattgtaatcggtgatgatttcggtcagcgcatcctctttgtctgtcgctccttcgttgttgtcgatattgggatcgaacaacgccgtcacatgcaacttgggtgcttgctgcttgaacaagtgataatagttgacagcttcaggaatggagctagtggtgagcatcgcatggaatttgcccgcatggctgagcaccgggaactgttcgagaatgtccgagaccaccatgttcggatgcggggagtcgatgccatattggtctcgtccaaggaaatcctcgatgccgctaatacagtttccagcgccatcaaccatcggacccatggggacctcagacttatccatgtaatgctggaatactttggccttgaccgggtcggcgagcgcatcttccgtactctccaccttcgccttgtcgagagccacggcacgtctgacttcagaatccttgtacgtggtcaccatgtacgggtcgaatccgagtacattatggtcacgaatgccgtcggcgatgctgtaccggtgcaagcaacggccgaataccatggcagtggtggaattcttcttctggttttcgtccagaatgggcgtaccggtgaatccgaaaaacagcgcgtttgggaaagagcgacggatattctgcaacatgtcgccgaatgtggaacgatggcattcgtccacaataaagacgatacgtcgtgcagctagctgatccagccatgtctgggtgacgcctcgctcccctgctttcacgttgctcatcttctggattgaggtgacgatcagggtgtcgttgacattggtgctgttgagtttgtcccgcaaaacaccggtgttctcggtgccttgcacttccgtctcgctgtcggcaaagctgcggtactccttcaacgattgagtacccaattcaatgcggtccatgaggaacacgactttatcagcgtcatgcgaatcggcgatgagctgtgccgatttgaagctggtcatggtttttccggaaccggtagtgtgccatacatagccgccgggtcgtcctggggtagctggccgctgttcccaatcacatttcctcaccacatcagagatggcgtttgccgcgatgtactgataactacgcagcaccttaaggcatccatccgctgaatcagcgatagtgtagaagccgatgagctgatgcgccatgggaatggacagcaggcctgcggtaccggaggtgcctccgatgaacagcttccattcgtctttgccagggttttgcccgccacagataggctcattgttgtagtcagcccaatggaagtaatagcttggattgaatttgtctacacccggattagcgaagtagacggcgtcatcggggttcatggccacaaaaatctgtactagacggaacaggccggtgaacacaccttcgtgcgcatatttctcgatctgattggttgcttggctgactggtatgccacttttcttgagctcgatatggatcaatggcatgccattgatgaggagcacgaggtcgccgcgccgcgagttcaacatcttgttcttggctggatagaccggttgctgagcgatctgataagtgcttttgccgcccgcgatttccttgcggtcatagatgtagagactgacttccttgccgaaatgcgccacatcttctttgttgtcacgcgtgatagacacggtacgcccgttgacgaacgaattgagcgcgagcggcgttcgcagggtctcgatctgctcgattatctgggtcatttccccgtctgtcagcgggtatttgccgagcctgtctatgtcattgttgttgcggtacagtatgcctttccaattgtcgagcaaatcccgctcagttggatagcgcaggacgccatccttccatccatgctgcttaagcacggtgatgacgttttcctcgaacaccgattcgctatcgaatatcatgattcttctcccctttggactttccattgtcctgcttttcgcgagccgacgcgcttaagtaatccacgcccaatgagtatttcagcatccctccgcacagtcgctgatgaaactcccgcggcacgtgccatgtcgtcatatgttgctctggggctcttttctacaaaacgcagaacaattcgctgtctctcggttatctgctcattcaaaccatttaactgctcattattgtcagttatctgctcattcaaaccatttaactgctcattattgtcagttatctgctcaccacggatgaatacatgctcattttgatcgagcttggcatccggctccaacataagcgtgagcaccgtacgatcagcctcgccgaagctctcttcaatctgcggttcaggaagtcctgcattcgcccatgtggcgaacacatcgggaacacccgtaccagctcgctcgcccacatcgattaggctgaacatcttcatgacaagaccgttgcgcggatcggacaccccgccaagacgcatctgctcaacgcccgttcggatatcgcccggattttcgaacaccaatctatcgggtgcgcgtctgaccaccacaccacgcacgccatagtaatcagcgttgaacaaacagttggccaatgcctcgcgaattgccttatgcatgggagtgtcatcaacgcggaagatgccattaagtttgaaaggggtcttcagagactcggcaagtttgagattcacgcggaaaaagaaatcaaagaggttgcctgaccacatgccatcgccggaatggacacgatcagtccaacgaatcgtcggatctagagtctcctgataatcaaggaaataatgcggacattcgcgcacgatgtcatagtcgttgccgaacataagcagaccgccgaacgtaggatgaagcttaccgtcttctcggctcaccattgccgcgccaacagcacgcagaaaacgctcgtcatcgagatcggtccaagaactgccctgacgtaccgcacggaaacgattgcgatatgcccgcactgtgtctgtattgaagtcggcaacagtgagatcgtccagcaccttggaatccatcgtctcagctccctgatcccggagcattgctgagatctcctgccgcgtgcaacggtagtcgccctcaccacgccgacggtaggttcccccgaagagatcattattgatatacacggggcgttcgtcacgcggagcgcgcggaacgtgaatagccagcactatcccaccatccgcttcgagcacttcaacttccgattcgatgggcagcacggcgcttaccttggaccggttgctgaccgtgttccaaaagtcctggcgaagatgttccgcttcagttggtgtaagtccaatcggcgcgaaggtaccgtcttcgcgctccttgacaccaagcagaatgacgccgccgtaggtgttggcaaaagcggagtaggtctcccatatgctgtgcgggaggccgcccttcgcggacttcgcctcgatccggttattctcgcgatatgaggcgagcttcacgatatcgaatgtctccattgctctacctcccttcacacaaacatcttgtcaagcaaggatttcttgatattctgcagcaattccaacttacgctgatgaagggtgatgaggctgtcaatctcattcaacgccgcacctatggcagattgctccgacaagccaggaaatcttacttgtgtatcttgcagtgcggcctttgaaacggagatcaccttgattccctgcattaagggaagaagctgtctatggtatgcatcggaatttaggtagtgccccaggtagcccgtcccaaaggggaaccgaggccgcgccggtatcgtatgtagccccgagatagttggctctttgggtagtttccgcagctcaacacacttgccagccgtttcgtcctctgccgtgtcagcgaaaatgacatcaccttcgcgaagtatcgacccagcatatttgggaagcacggtatcgtcggtaatgaacggcaaatcacttcgttcgccatcgaggcaatcaccgaacttaataagaatatctccgtaatgaacattgcgagcagtgccattctcgccattcaaaccggcacgtgaaagagtgttgctcttcaagaactcgaagcaatccccaaacttacgctgttcccaagggtcagtaaaaccagcgaaacgaatctcgggtacagactcgccatcctttgggaacattttttcaagcatcgactttttgaacacgacgagcttgtcatacttacgctgatgaagggtgatgagcgagtcaaggtgactcagcataaagccgattttttgttgctcaggtaaggacgggatggatacttcaaggttcttaactatcacccccgatagattcccttgaccaccttgcaaataggttgtgacaatgtaacctttttgcttcctcagccaagcagtgatgtatcttgcatcacaatcgtcgcgagggagtatggcgagaatagcttggttgatggcacctttttgcctcgatacagccacctcgccacttgtcgctccgtacaatgcatacagcacatcgccgggtttgaccattctcgcagaggatgattcataacctttttccgtaagaaagagttcagtcgattcagctgcaatttcagcagacctgataaaaggaatagacccaccgtaaaactcagattctccagcagcgggcgtacctcctgaatagctttcggttagttcacccagcttacgctgttcccaagggtcagtaaaaccagcgaaacgaatctcgggtactttcgcctgttcagtcatcattcgcctcccaacagggtcttcagctcggcaataccggccatatcgaactcattgccggttagttgaccaagcatattgccaagttttgcctcagcctgttcgatctgttcgcacacatcagagtatgtggtcgaatacttgtcgttcagcgcattcaccgctgcaatcaactcatcaacagccgtctgagggagctcctcaagcttgcgctgcaatggttccacccacttggcagcaagcaagtcatcagcatgttcatcgctcagtccttcaataacggtccgggtcttttcatcaagcgctgaacggagattcttaacgttctttttgacttcacgctcttcatcaaacaaccgctgtgcactcacaagagcacggtcaaagtcagtctcgggatgcttgccgatagacttcactgctttcttcaactcagcggcaacaaaagaatcaccatcctcgctgatagcaccggttgagctcttgtcgtcttcatccagattttcaagaatgtcggcaatctcaccactaatctctcttaaccgagattcatatgtaacaatttccgcaagatcagcagtaagcagtttgctttgcacaagatcgaacggcaggatatgtccagcccagccatccggcacttcgacattcttaccgcctttcttcttaacaaccatgttggcgtcaactttgcgaacggcgtcatggccctcgctctgtatggtttcaaggtcggtggagatggtcttctgccagctatcgtcaagcacctgatatgccgtataggcatctacgagcggtatatcagtcaaacgatgtagcaggtcatgtgccagaacctcctcttcggcggcaatgctcacgttggcggcgttacctaccagttcatcacgcagataggcaggataatcggtgaatacctcacgatatcgctggatataggcactcacaccagaatcagcattcactgcctcgcgaacatcttgcacagcgagcctggccgaatggccgttctcctcagcaaagagacgttggcgcaatcccgggaacacgttccaatacttaccgagcgcatcgatatcctgcttgggaatgccaccaaacatggtggaatacacgtcccaactttcggcgctttcagaggaatccacatatcggggaatattgaggttgtaatcgttctgccgaatctcatcaatgctcaccaaacggctgaacttatcgatatcacgattctccgtcaccacatccacgatgcgtttgatatcgctcgcacgcagcttgttgttcttgccgtccttagcgaaatatttggaggcatccacaacaagcacatggtcatcgttgcggtgcttgcgcagcaccatcacgatagtaggaatgcccgtgccaaagaaaatgttcgctggcagtccgatgatggcctgaatatggtggttttccactagattccggcgaatagcgccttcctcaccgccacggaacagcacgccatgtggcaacacgatggccataatgccgtcatcacgcaggtgatagagatcatgcagcaggaaggcataatcagccttggacttaggcgcaatgccatattcgaaacggatatcttcgcccgcttccggcggctcccagttctgggagtagggaggattagagaccacggcgtccacaaacagcggctcataggtctcgtccttcgtctcgtcggtatcgaaccatggccagtcgctttttaacgtgtcaccgttacgagccacaatattgtctggcagtatgccacgcatgacaagattcatacgcgtgagattgtaggtattctccttgagttcctgtgcgtaatacttgatgtcattcggattgccattgcgacgggccacagcctgaccgatatggatcagcaacgagcccgagccactcgtggggtcgtagatattgatttcttcacggccggcgagatgccaggccactatttcgctcatgagctgagagacttcgctcggcgtgtagaactcaccggccttcttacccgcattggaagcgaagttgctaattagatactcatagatgaagccgagggtgtcgtagtcctgccggctgtccatcggaatgtccttgatgaggtagatgaggtcgcggacagccttgctacgacttttttcatcggtgccgagtttggacagaccggtttgcagcgtgtcgaagatgccaacgaacacacgtttacgagccggatcaatgttgcgttcgaaagcggaaagcgcgtcacgtacatcagcgatggtgaaatcgccctggctggcaatccacgtggagaacaggttgttgtaggagatgaagtagccacatagatcacgtacatactgtacagtttcggcatcattctcatccaagcccttgaggtcttcggctccccagtcttcagcacgcagacgagcaatctccgtctccgagaggaacttatagaagataaagccgaggatatagtccttgtattcattcgcctcaatcttggaacgcattttattggcggattcccagattttggcggcaagctgctgcttattcattcatatgctccttgtttctgtacacgtaatcaagggtctgtccttgttcattgacccattcggtccaaccgttttgactgccaccaagaacaaatacagcagcagcggaagggcttgacagttcaatgtcatcagcaagagtcgccttgcccgtctgcgttccgaaaagatgccgccgagctgccacggctccctggtttttgataactggatgcacgagatccacttcagaaccggaaagaacagtgaaacgacctgtaccttggctatatcgcccagtggcctgaacaccgttcttcttcgtatggaatacggcgttcaccataaccggtgtcttttcttttcgatcaaggtcatatccgagcactcgcatacgaaagaggatgttattgtgcagtctttccacctgttgctctttgtatggattcatgcgaggagcaggagtatactcattgtcggtctcataagagccatgtttgtccacataatctatggctgttgactcaagagagtccaaaacatcacgatcgatattgacatcattatcgaggaacatgatggctttgttccaaaaatctttcttagtcttgtgcgcatcaagccgattaagccccttcgtggtttgtcccacatacgcacggctcagaactccatgatcttcatcaagaagataatacacaccgcgatccggcaaatcgggaagacttttcgcctcactcaacatatcccggggcaccacaaccgtgacaagcgactccccatccacacgacaaattcgaatgccatcaggattgttgtcaataatttgtatggtcatagcagtgagagcaatcatcacttgccgccctttgctagttcattaatcatgcatgttctcacgaatgccgaaaagctcatcccgcgaagagatgcggcctctttagcagaatctcgcaaattagcggggatacgcatagtaaccggcaccacatcaccgtttaccagatacgaacgtatctctgtttcaccagcatcatgctcaatcagatcggagtacgtcattgcattctacactttcaaactgcaatacaaatgcaataattctacacccgcttgggaacagcgtaagttgggggaatttggttctgttgccatgtgcaagcgcatctacaaagagcaaacctcggagcagggcgatgttccgttctttaagattggaacttttggtgcggatccagatgccttcatctccaatgagctatttgaagactacaagcgtacctatccgtatccaaccccgggtacgttattgatatcggctgcaggaagtatcgggcggattgttgagtaccaaggtgagaaggcatattttcaagactcaaacattgtttggctcgaacatgatcatagattgaacgatgcgtttctcaagcctttatactccaaaattgaatggggcttagagggcagcacgattaagcgactttacaacaaggacttactgagcgcagaagtcactatcccagacggtagagagcaaaaagaaattggccaattctttgctaagctcgactccctcatcacccttcatcagcgtaagcgtctgtggtttgctaaataagggtggataaggctctcatcacgatgtcaacgtctttgttttccaattcgcggatgacatgcagatatatttcctgcgttgtgttcatgcttgcgtgcccaagccgtttagagacgcttgcaattgaaacgccggcaaatagcaagagtgaagcatgggtgtgtctcaatccgtgtattgaaatcacaggtactccggcttgtttgcaatgccgggccagaataccgttggcggttgagttgtataccttgccatccacgaagataggcttgtcaccgggtaagctcttcaacagaacagacaactgcatgatgagttgccagtcaagttgtactttacgtaccgaagaagcattctttgttggaacaaagccacctccattcttgtaattccatgtcttattgacggacaaagtctggtgaacgaaatcaaaatcatcaggagtaagccccaatgcttcggagaaacgtaacccggtttttgccactagcagtatcaaccagtcccagttaggtatcggatcaagcttcaaatcagcaaggacagcatgaagttcgaactggttaagatatttcaccttcttctgtctcggctgttttcctttgatgattgcttttcttgttgggtctctctgaatcagaccttcatcaacggcatcgaggatggctcctttcagttggtgatgaaaatccattgttgtctgatgctcgtgatgctcagcgtatccgttgatgagtttctgatagctcacacgatcgaactcggaaagcttgagatcagggataagttttctcagccacgcctgtgtgagcttgtatttcttcattgtcacttcccgaatcgcgccttccttgtagacgtcgacccattgcgagtagtaatcgcagaacgacatttcttcgttgattgtgtttatgaccacacggggctcctttgccgaatagatagacgcttacgctgatgaagggtgatgaggcggtcgaggtcggcgaaaaagttcccgaggtgattttgctcaactacatttggaacgcttagaactgtttcattaattgattctttcgataggcttggcaatcccgtcgattcgtctttggatttccaatcaacattcaaaaaggagcagagggcaaactcaaggttgatatctgactttggaattgcgtaaaacagcgtgtcaaccgtccaaaatggcgcttttaaaagataaggcttatcgatagtcccttttctaccgatgccaatagcgtcacgattatgcgacagcgcctcgctaacgctggtcatatacccgccggttccataaaccggaataggcccttcatcaagatgtttgtagtcacgtccgctgcagacatctacgatttctgagaacttacgctgttcccaagcgggcatcggcactacatgaagcagggcagacgggatacaagtggctggccgaacatacgcaatacatctaccggcgacttggacactaccatttccgctgttagccacacttatcgcgataagtgtagctaacgacgattggagcgacaccttacaagccatgagaggtataaccgttcccttctattttgaaaaacttgaataagttagatttttcaaaatagggatgcgtcgaaaagacgcataaacgcacgaaaaatgcgggcatccgacatgcagtgttcattgaatcactgtatatcggatgcccgcaatcgtttcaagccgattgaagagccttagctcagccgcccatcagcatcacgccttaacaacctctacgatcagctcggcaccttccttcacctcgaaggaggtcgccagcgtctcgtgggcgatcaggtcgcggaactgctcgaccttggccacgtcatccgccggcacggtcagcaccagcgagatgcggtccgcgatgtccagatcggcagccttacgtgcgtcctgcacagaacgaatcacgtcgcgggcgtagccctcggccagcagatcggcatccagcgcggtgtcgaggatcacgaaaccaccggtcggcagcgaggcggagaccgaagcggcggcctcggtggcgttctcctcctccacacggttgatcagctcgtactcgccttcgaccagcgcaaggtcgccggacggcgtcgagaccaccggtgcaccggacgcggcatcaacatgccaatcgccggacttggaggccttgatggcgaactgcacctgcttgccgaggcgcgggcccgcaacgcgagcgttcacacgcagctcgtgcacgatcttcagaccgtgggcggcggcgtcttccagagtcgagaactcaatattcttaatgtttaattcagacttcagcaactcgtcgtatgacttgacggcgtccacgttctcgaccaccacggtgagcttggaaagcggctggcgcacgcggatcttggcggccttgcgcagggacagggtgccggaaacaacctcgcgcaccttctccatcgcatccaccagagccgggtcgtcgaccagcacgcagccgagttcggtgtcttcaccggtcttctcgtccaccacgaacggccaatcggccaggtgcacggactcgccgccggtcaggccgcgccacacggactcggcttccatcggggccagcggcgcaagcacgcgcatgaacgcttcaagcacggtgtacagcgtgttgaacgcggacgcatcctcgttccagaagcggtcacgggtgttgcggatgtaccagttggtgagcacgtcgatgaagtcggagaccgcatcgcaggcgtcggaaatcgcgaactcgttcagcgacttctcggcggccagcaccaggcggcgggtacgggccagcaggtagcggtccatctccggcagaccggcgacctcgtccgcgcgcagctggcgggcgtcgaatccggccccgccgttggccgcgttggcgtacaaggtgaagaagtagtaggagctccacaccggcaacatgacctggcgcacggtgtcgcggatgccatcggcggtgacgattaggttgccgccgcgcagaatcggcgaagacataaggaaccagcgcatggcgtcggaaccgtacttgtcaaacacgccgttcacgtccgggtagttgcgcaagtgcttagacatcttctggccgtcggagccgagcacgatgccgtggcagatcacgttcttgaacgccgggcggtcgaacagggcggtcgccatgacgtgcagcaggtagaaccagccgcgggtctggccgatgtattccacgatgtagtcggccgggaagtgctgctcgaacttctccttgttctcgaacgggtagtggaactgcgcgaacgacatggaaccggactcgaaccagcagtcgagcacatcggaaatacggtgcatgtgcgacttgccggtcgggtcgtccgggttgacgcggaccaggttgtcaatccacggacggtgcatgttgatgttgccgtccttgtcgcgcgggtagtcaccgaagtcggccttgagctcttcgagagaaccgtaaacgtccacacgcgggtacttcggatcgtcactcacccacaccggaatcggggaaccccagaagcggttgcgggagatggaccagtcgcgcgcgttggcgagccacttgccgaactggccgtccttgacgttgccagggatccagttgatttgctggttcaattccagtagacgcggcttgatcttggtcacggacacgaaccaggaggagaccggcttgtagatcagcggggtggcgcaacgccagcagtgcgggtaggagtgcacgtagctcttctcctggaagaggatcgcgcggcgctcttccggaatctcggcgagcgggccatcgccggcgcgcaggttgcgcaggatcggcaggttggcgtcgaacacgaaatcaccctcgtagtcggggcactgcgcggtgaagcggcagccatcgtcgagcacgtcggtgctcttgatgcccttagcgttcagcgtgttcatatcgtcttcaccatagggagcctggtgaaccagaccggtaccttcaacggtgtcgacgtagtcggcggtgaagatcgtgtagccgttcgggccaggcacgtggccttcggattcggcctcgtcacccgcgaagtacgggaagaccgggtagtagcggcggccttccagctcggagcccttgagctcgcgcacgacctcgtagttctcgccgagttccttctcatagtgcggcagcaaatccttgccgaggtagaacttcttgccagcgaacttgccttcggtcgggcggacctcgacgtagtcgatgtcgccgccgaccacgatggcgaagttggtgggcacggtccacggggtggtggtccagaagacggcgtaggcgtcgtcctcatcgcgcatcttcacggccacggacacggtggtgtcctggcggtcctggtacacgtcggcgtccatgcgcagctcgtgcgcactcaacggcgtgcggtccttcgggcagtacggcagcacgcggtagccctggtaggccaggcccttgtcgtagagctgcttgaaggcccacatcacggattccatgtacgggatgttcagggtcttgtagccgtgctcgaagtccacccaacgggcctgacgatgcacgtagttctgccattcgttggtgtacttcagcacggaagcgcggcaggcgtcgttgaacttgtcgatgcccatcttctcgatctggtcgaccgagtcgatgccgagttccttctgcgcctcaagctcggcgggcaggccgtgggtgtcccagccgaacacgcggttgaccttgcggcccttcatggtctggtagcgcgggatcacgtccttggcgtagccggtcagcaggtggccgtagtgcggaagaccgttcgcaaaaggcgggccatcgaagaacacgaattcgttctggctgtggtcgccggaagggttgcgttcaacggacttctggaaggtgtcgtccttgtcccagtagtcgagaacggtctcctccatgtcggggaagctggggttcggcgcgacgtgcgcggtctcgccgccctcgttcgccttgggatatacgttttcgctcaccgtaaatctcctgttagtactgtgcactggtcctacaggagcgtcattgatggcgattgccgggcgccgacgtgtgccggctgggttcacgaatgtcacgtaccgaaccgtggggccgatcgcgtcaatcgcctcgcagccggaactgactgtgttccgcccggaacagccctgtctgccgttcctgcctacgaggacgatgacgggcgctggtatgcgctccgcaccgcggtaccacctcgcttatcgcaccggttgcgccgctccgaactgttgcactcggagccgcgagcctgcgcgaccgcttgtgttcggctgtctcgggccgatcccgtcggttctactgggcgattgccgccgttcttccgaagactccccgctgataacggatcactgcctcacaacggtgcatatcgtaacacgccacgcggtcaaatcgccgcccacggccacggcaccgtcaggagcccgatttagattgggaccggccaccacggaccgagaaaggattgtcggacaatgacgtatgatttcacgtccatcatgaacaggcatggcatggattcgatcgcggtcgacggactgggcaccgacccgggattcgcgccggacccgccacgcgagggtttcgacgtcatccccatgtgggtggcggacatgaacttcccgaccgtgcccacgatcccgcaggccatcatcgaacgggcgaagcatcccgcctacgggtacttctcccccaccgacgactattacagctccatcatcgactggcagtccacgcgcaacggggtcaccggattgacccgggaggcgatcggctacgagaacggggtcctgggcggtgtgatcagtacgctgaccgcgttcgccgcccccggcgacggcgtgctgctgcacagcccgacctacatcgggttcacccggagcatcgaaaacaacggctaccgcatcgtccacagtccgctcacgctggacgagcgcggcgtatggcgcatggattacgaggatatggacaggaagctcaaggagcatcacatccacgtggccgtgttctgcagccctcacaatccttgcgggcgcgtgtgggaacgttgggaaatcgagaaggccatggaagtgtacaaggccaacgattgcgtggtcatttccgacgagatttggtccgatttgactctggggaaccaccagcacatccccacccaatcggtcagcgaggacgcacgcaacaggaccgtggcgttctacgcgcccagcaagaccttcaatctcgccggactggtgggaagctaccacatcatctacaatcccacactccgggaccgcatcgtggccaaaagctcgaaatgccactacaacgacatgaacgtgctttccatgcacgcgctgatcggcgcctaccggcccgaaggccatgagtggctcgacgaactgaaggcggtgctcaccggcaacgtcgattacgcctacgactacatcaccaagcatttccaaggagtgagtctggccaaaccggaaggcacctacatgctgctgctcgactgcgagcagtggtgcgaacgccacggcctgagcctgcccgagttggagaaacgcggctgggatgtgggcgtcgcatggcaggacggcgacatgttccaggccccctacagcatccgcgtcaatctcgcattgcccttgagccgcgtcaaggaggccatgcgccgccttgaccaatacgtattcaacgcgtaaacggcatgcatccgcgattgcggtgtcctggaaagacgaatgccgtcaacgaggttggtgcccgttggcggcattcgtcatacgttggccgaaccgggcgaaacccaagttgccaagttgccgtgcgctatgaggtggatgccgccagcggacgtgtacatctgaccgcccgatatgccggtgccaccgatgcgccgacgctgccggcattcggattggaatggacacttcccaagcagtacgagaacctgcgcttctacggccttggccccgaggaaacctatcacgaccgtctgcacggcggcaagctcggcattttcgagcgcaccgcggccgaagacaatgcaccgtatctggtgccgcaggagaccggcaaccatgaagacttgcgttgggccgaagtgcttgacgcccaaggacacggcatgcgtatcagccaggccggcagcgaacatttcgcggcgagcctgttgccgtacaactcgctcatgctggaagaggcgacccaccagaacgagttgccgccggtccgccacacgttcctgcgcttgttggccgcgcaaatgggcgtgggcggcgacgattcatggggcgcgcccgtccatgagcagtaccagctgcccgccgatcgcgcctacacgctcgacgtgaatctggaactgttctaacagcgataaagaagctccctccacagagggagcttctttatcgcacagagggaacttctttatcgtgctggtacgaaactgtcacgcactactagggtggtggagatgaaggtgtggtggtgcagcgtgcgccgactggagatggcctcggcaagcatcgtaatcgcagtatcggccagctcattctgatcgatatcgtaactggtcaatgtcggcgaagtgtactggacgatggcctggttattgatactgatcacactggtatcgcgaggcaccagcactcccgcagcagtaaacgcctgcagtacgccgactgcaatcgtgtccgcagccacgatgaacgcatccggcatgtcatctcgatgatcgttagccgctttctcccctagagtgcgcccggtgtccacagtgaacgcgccttgcgcgtaaatcaggccttccgcatccagccccaaacgctcggtccaattgcggaatgcggttaatcggctgtcttccgggtattcgtgcaaacccatcgtgaagccagtaccgccgatatagccgatgcgtcgtttgcccgaggacaccaacacatccaatgcgtccaaaatggtttggcttaaatccggttgtaccgaatcgaacaggctgggcgcaggattgatgtcgatgaatacgccatagggcaataccagatggagtttcaacagtttatccgaagagagtacggacggtccgatggaaatgaagccgtcgaaatcaccggcgttggcaatcagatcgtcgatatgggaaaacgacgtgagttccatgtgctgggctctggcattgtcgccgagcacggaccgcagttcatcgaaataggcgtccgccagttcttcctcgcgggtggcgttgtcgagtacggccacacggcgtggcaatgcgatacggcgtgatccggtagcgtagccaagctgctcgctgacctcgatgatgcgacgtcgcgtctcctctttgacggacaatgtcgggtccccattgagcagccgggataccgtggcctgcgagaagcctgatttctgcgcgatttccttcatcgtgaccatagttgagcctcccccgccccaatacgcaatactacgtagtatttcagtaaatatctttactacatagtgtaactcacgtcatgcgggtatgacgacgcatggttgcagcatcgtcatacccgtagcactgatgagcacgtgcatgtttcatggccctccgataattatcgggcaggagggaatccccagaccgtggaatcaatgcgctggattttcccggacttatcaaagacaacggtgatgtccgccgcagtaaaactgctggtcgaatccccgaatcggtacggatcactccagtcgatatcggcatgcatcgtcacggtccgagttttcgcgtcacaggactcattcgagtactcgatactgttatgcgtggccgtagtcccgcccagaccgccgccattgccttgatgcatttgctgacaatactttgtaaaatccatgccgagaacactcgacactgcatagcgcctaaatgaacgtgttaggcctgcaccaattcacggtcggcaatactccacacttctcagtaatcaattcgcaccaaaccgctcacgaatctgagcagcagtaccataagaggcttgcgcaccgaacccagtcgcggcgtacgcggaaacgtatgaggccaactgcgcactgtccgccaacgcatgacccgaggcaagcccggccagaaccgtgcccataaaggcatctccgcacccggtagtgtcgatggcctcaaccgcaactggcgcaatacgatagatatcatcaccatcgatgactaccgaaccatccccgccaagcgtaattaccgcctgattaaagccgaagtcatgcatctgccgcgccacatcagaccagtccagtccatcccaatcgtcatcgtccggctcggcaatgcccagtagctgtgccatttcatgttcattgaccagcagaatgtccgaagcctcgataagttcagcgggcagttcagcaacgaatggcgaatcgttgagcaataccttgagcccggcatcatgacagaggcgagcacatgccgtgaccgtttccatcggactttccaaacacagtcccagcacatcggcggcaaccaatgcgtcagatgtctggcgcacatagtcgacagacacctcaccattggaaccagccgaatatacgatggtgttctcaccattcgcatcgacagtaattaccgtggtgccactgggcccagcaacagcagcgatatgcgaagtatctacaccagcatcgcgcaaatgttccagcagaaaatctgcattagtgtcttcgcctaccgctccgaacatctgcacctgcgctccaattcgagcggccgccgatgcctgattcgccgatttgcctcccggtaataaggttagcggaccaccgttgacggtctcccccggtttcggcaaccgctcagtgacgaccgtgtaatcaacattcattgatccgaccacggacacactgccgtgcaggtggtcgagcaagtcaagacatgatgctgacatgatgcatttcctttcggccttcttgtttcggcctgttttctatgttctgcgcttgttctacgtttcagcaaaatcacgatggaaacaatcgtgcgggtatgcaaatgcccggagtctgaagtcaaatcccgggcattgcacgtattcggggccagatcgtctgcgcgattgatatgttctgctgacgactgacgcctagcggattgtgatggttatatcagcatcacgcacccatcggcaggaagattgccatggacaggatgaacatgacgattacgccagcgatcatcggcacactggtacggcgcacaatgtcgattggactcttcttgatggagccggcgacaatcatcaccacagcggagaccggcgagacagcgcgcagcagattgccagcgagacccatcgggatggacacggcgagcacattgataccagcagcagcagccagcggaaccatgagcggaaccatcgcgaagaacagtgcggtaccggaaccggagagtagcacgatgagcgcagtgaggccgacaaggataagcggcaacacgaagcccataccagagccggacaggccggtcattgcgttctgcagctcagtgatcagaccaatggacttaagaccaacgacgaacacagaagcagcgaccaacagtgccacaatcggcattgcgccacccatgcccttgaagaaggactcagtgccagcgagggtttccttgcccttgcgagtgcggatgagctcgcagataatggcgatcacgaaggagagaatggaagcgagttcaacactcaggttgatctttgcgccggtggtggaagtgatggcgaacacgatgagaagcatgatgatcggcagcagcggcagaatcgcatacacagtgcggtagagagcgccaccttcgacagccttaacctcagctaggtcaacatcaccgtcggtcaaatccgagccagcgcgcttgtccatgaacttctgccagaagtagtgtgccagtgccatgacgagcaaggtcgggatggaaacgagcacgtgataacggaagacgtaatcgctggcggtcaggccggagaacatgtcggtcttagcgagttcagcggcgatggcaacattgtcggagccaagcggggtcggcataatcgttgcagtagtggcaatgactgcagctgcgctcagcaggctcataccagcttggcgaagcaccgggtacagcgttgccataaggatgatagccaggttggaagcactcggaatgaccagagacaacaggttgcccaacaagaaggtaatcggtacaaggatatacggggacttgatgtgcgcaatcggcttggcgagcacgcttaccgtgacttcattggctccgatatgggacatgtagccggtgtagccgccaaggatgaggatgatgaagccagcagaagtgagcgtgctcacaaactgatcgcctacaaccttgaacgggtcaagccaagtgacaccactggaaacgaagtcggcgaatgagatgtccttgcccatcagcaatgcgatgtacatcagcacaatgccgatgaggaacagggaaatcttgatgtccattttcttcacgagcataaagcccacaatgccaaccgcggcaattgccacgaggtacataatcaccagttccatcggtctggtcctttctttgttctcttattctctgttgttgaattcacgaatattgatgcgctcaggggcgccggtgttagcggcgtcgaagagacaagggactatgcacagtgggcgatgccgtccatgaaccagtcgcagaatcgatctgcgtgaacgccggtggtgacggtggcattcggttcgtgcttaaggtagcccttaagatcaacgaccgtacaccctgcagtgagttcgccagcgatttctacgtccacgaatgccttagtcatgtcgaataggtcaggctccagcaagcatgcgactgcgcaagcgtcatacattttgagaccggtgccgaagctgcgcttgcggtagcgctggaacaggtcatgagccatcagaccgaccttgcccatatccttaagctgagcggttttctccggcggaatcacagttcccaagccggcgtccagtgtggccatagtaatgtcaagaccagaagtgagcacaatcttggcggcttcagggtcaacgaaaatattgaattcggccataacacccttgttgccgcgagtgaccgaaccacccatgagcacaatgcgctcaatacgcgacttgacttccggaaaagcttttagcaacagcgcgatgttggtcagcggaccgattggcatgacggtgacgggttcagcagaagccatgatctcgtcgcgcattgcctcgacagcatgcttatccagcagaagttcagttttgggctcagggaaatcgaatccctccataccggttttaccgtggacatcgcttgcatcatcaagctgacggatcagcggttcagcagcgccacgagcgaccggtacatccttaccgtagtaggccatcagcttgagcgcgttcgtcgttgtcgcttcaatgctgacattgccagcaaccgtagtaatcagccgcacgtcgaagcgcgggttgaacactgccagtgcgatggcgacggcgtcatcgatgccggggtcagtgtcgataatcagagggatctgcttcattgcttgttcggttcctttcgtggtgtgttgatatacgcgttatgcgtattgctcggcgagccgattacttgatttcgcttgtggcggtggattcagctgcgctgagcggaatgggatcaacgaattggactaatccgctgccataacccggtgccggccggcgcaggaatccatgctcttcgtagaacgattccttgccaggtgttgccatcaggccaatgtacgcatggttgcagcagtgttctcgaatgcgtgtgataagtgcgcgcagcaccgccgtaccgaccccatccccttggtattgcggtaataccacgagatctttgatgaagaatgcgatacgtccatcgccgactacacgaccaattccggccacctgaccatcaacgtaggcaaccacggaatacagcccaccatccagcgccatacgcgcgtcttcgcggtcgtaatggtagaaacccacggcgtcgcgaacgctgacgtacagttcggctgtcagcgcgtcttgctgaatcgatatgcacattgcccgctcacctcctctgtgagtttcctccaaaccgatcttcgttgatcatcgccattgataaaacgtttaatcaactaatgaaaattatgatataaccttttaccaatgctgtcaacgatgtcggcacgtcagcactgttcagcgcataaacccagccttcatgcacctgataaacgctgcaatatcagggcacacgccacataggagccccaaccgaatcacgcagtacaaacgatgacgggacatagcgcgattcaccacgactgcaatcattatttataatcatgtcgagcaacatatccacgccctggcgacccatatcctcagcttgctgcgaaataatcgcgacttgcggagtcagcagacggaatacggcaatgtcatcgaatgaaatcactgacatttcactaccaatatcaatgccgcggtcatgcagcaaaccaatcatcgtgatcatgtcaggcgagtaagcgcaaataatcgccgtaacatctgctcttacaagttcatttagtcctgcttcgcgcgaaacatatgtagaatcacagtcgacaaccgccgcagttccctcccccaactgcgtcacctgtgccacagcagaacggaatgccgcttcacgctcatttatattggacgagcccagtgacgagtgtgacacaaatccaatgtgacgatgccctaagcgcacaagttcggcaaccgcctcgcaaacacctgggtatgggtcggacactacgaatggcaccgaatttactcccgataccaaacgatccacgaacaccagtggtagctcgcgcgcgataagcgactgcataccaggcgaattgacaccttgcggcaccacgattgccccgtcaatacgttgcccaagcagattgtcaataaacgcatcctggcgttccactgtttctgctgaagtaccaatcagcgtggaatagccctgggcatacaactcgtcttccattgacgagactaaatcagcgaaatacggattgcgcaaatcaggaaccagcaggccaacagtcttagtatccgacgagcgcatggaacgagcacgttgatcgggcacataccccatttccgcaacagttttcagcaccaactgtcgcgtatcactagaaaagcggcctttattgtgaagtatctgggaaacagcagcagccgatacaccggcacgttgagcaacatccttcaacgtcacgaacgccatagtcccctccttgcggccgatacatcgtcaaagcaacaattcaaatgtacccttttcaccgccaatattcgcaatcctgcgccaacacacggctctcaacatagaaaaccgcaccccaaccaccggatgagaattgcttcaacccgataatcgaggtgcggtttttgcaggcgtaccggctactccagctccaccgcgccggtgtacagctggtagtactcgcccttttgcgcgatcagctcgtcatgcgaaccacgctcgatgatgttgccgtggtcgagcaccatgatcacatcggaattgcgcacggtggacaggcggtgggcgatgacgaagaccgtacggcccttcatcaggttatccataccagcttgcacaacctcttcagtacgcgtatcaatcgaggacgtggcctcgtcaaggatcagcgcaggcggatcggccaccgccgcgcgagcgatggagatcagctggcgctggccctgggacaggccggaaccgtcgccttcgagcaccgtgttgtatcccccgggcagcatgcggatgaagctgtccgcattgaccagacgcgcggcctcgatgcattcctcatcggtggcgttcaggcggccgtaacggatgttgtccatcacggtgccggtgaacaggttcacgtcctgcagcacgatgcccaaagacctgcgcaggtcaggcttcttgatgccggccacggagataccatcatacagaatctggccttcctgaatgtcgtagaaccggttgatgaggttggtcacggtggtcttgccggcaccggtggcgccgacgagcgcgatcttctggccgggcttggcgaaccaggtgatgccgtgcagcaccggcttgtccgggttgtagccgaaggtcacgttggtgaagcgcacgtcgccgcgcagcagggtcagtcggccgtcgggcgaggtgatcgcctgctccttggccttcatcgccacctcgcgggccgagcccttgagcttttctgcggccttcagagacctcgtaccgtcgtcgccgacctcgcgcttccatgcccagtggccggtctcgtggtcgacttcggtcatggtgcggccatcctcgccaagttccacgttcacgagcgtcacggtgcccttgtcttcctcgatgggctcatccatcagcttgaagatacgggaggcaccggcgagcgccatcatcaccatggtcagctgctgagagacctgaccgatcgggttgatgaacgagcgggacagggtcagcagggagacgagcgtgccgagggtgagcggcttgacgccggtcagaccgatgtcgttgacgccggccagcgagacggcggcgccgacgatggcaagcaggatgtagagcaggtagcccatgttgccgacgaccggcatggtgacgttgccccaggtgttcgcttcggcggacgcctcgaagagttcctcgttcttctcgtcgaaggtcttctgggtggcgtcttcatggttgaagaccttgatgaccttctggccgttgacggattcctccacgaaggcgttcacgtcgccgatccactgctgctgcttgacaaagtagcggccggagcggctcacgatcttgcgcacgatgaagtagagcagaacggtgaacacgattacgaacgcggtgaatggaatggacagccacagcatggacagcagcgccgcgaccgcggagataatcgaggagaacatctgcgggaacgactgcgagatggcctggcgcagcgtatcggtgtcgttggtgtagtggctcatgatgtcgccgtgctcgtggctgtcgaagtagcggatcggcagcttctgctggtgggcgaacatgtcgtcacgaatcttcttgagcgtgccctgctcgacggtgacgatcagccactgccacagccaggacgccacgatgccggccacatacaggcccgccatcaggctgatggcccgcatcaaaacaagccgacccgaaaccagccgttgcacttacaagttgaatccgggtaaatatttaccggtgaggccacatgcctataaagtggagtatcagcaacagcgacactaaggcagcgataacgatgaaatttgaagactactctcccgagatacaggccaaactcatggaaatcggcaacgctgcggcagatgccgtggagtctcaggaatcaccagcagaaggcattcccgaggacagcccaaacttctctcccgaactggagctcagccgtctaatcaatcgacgcaaagccgaactggaatacattgatgcccgcattgcgcagatggtactgctcatgcatgaacgtggccaatcatgggaaacaattggtcgcaagctcggtatcacgggtgaagctactcgtttgcgatatgccaagatggagagaccacggcaataactgtagtgccagctgagttcgcgaatcatctcggcgagagaggcttcatcgctaatcgtcatattagtcagttcagacgctcagctcttttgtcggcactcggcaatgagggcggcacagagcaaaatgacctgggcgacgaggttgaaccaaatgagcacaccgatcaacgcggcgaacggggcaagcatcggattccgggaggctccggctaatagtcgcgcaccgagaagctgcattgcggaaaccgtcagagatcccagtaacgcgccgagtatcgtgaatcgtccggctttgatgtgggagaccacgcgcagcagcaacatgaacaacgcaaaattcagcgcgacgccggtaccgaaaccggtcatctccaaaagcacggtgccgggcaacgaactgctggggatgccgccccattgcagcagtcggcgtacgatgccgccggacaccgtaccggccgcggtcgaaagaatgaacagtattgcgatggcgatggcggcaagcgtatcgcgtaaccttgcgacgacgatattgagctcgtcgccgcagtcgtcgaacatggcccgtacggcgtggcgcagcgagttcatccagccggtcactgtccaccagaatatggccaacgtggccagaccggtccacgtcaatgcgcttgacatggcgcctagcgcggaagacgtcagaaacgagtcggccacaccgggaatgacttcacgcaccgcgtcaatcagcatctgctgccaatcaatgttgccgaccatgataaggccgaacacgctcaccgcaatccagacgccggcaaaaaaggcgaacagcagaccatatgccagaccattcgccagcagggggccactccgcgacacataccggtcgaacacgcgcccaggcagcgaacgtgcccacgcgtccgctcccctgtcaatcgcactcttcaacccatgcatagttcaactgtagccgttgttaccgttgttgaaacagcatggcgcgaaatcgcatttagccagcccaaacgatggcaaccatcaacgcccccactcaattgttcagaatcggatatcatatgagtattcagttcatccgtcggagttcaatgtcagcagtcctcaccaactgatgtcttgctaacccgctggccgccctagtatctactgtttcttgtggtcttcgttcaacagccagtcaagcgcgtatacctgtcggatgccttttgcccttgatgtcgtatcggtgagccgggtagaggatgaacgcgtcgtaggccgcgatcgtcgccggaacgggcacggtcaacgactaggaaacggtttttatcagcaggagattctgcaatccggatggcatataccgcccggcttcattactgctttggctcttttctgttcacttcacgctggagtaccgagacacgttgcggaattagtccaccagaacttcggcatattcggcaggttcagcgggttcgatatgtcgggcacgcatggcatcgagggcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcaccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggtgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacaatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgcgcaacttcacgtcctaaaacgcgcgcctgcccggagtcaaccagatcggcggctttagatcgtgaaatacccagcattttggccacggctacgtcgaaacgcttacccaccaatgcatcgggagcagggactattcgactcattacttggcgtccgcctccggctcagactgtagggattcgtcggattgctcgatgagatccttgtgtgagaacggctcccccataagaatcagaatcaccagggccacaccggcgactaccagatagatatccgccacattgccaacggaccagccatagttaaggaaatccaccactttgccgtcgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcacgcgaatggtctgaccgttggataacgcggccatcgcccaagccttggtgagctgatcgacaatcagcgcagccgcggccacacatgcaaagacggccacgcgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgcacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcgaccttagaaacctgagcacgaagctggttttcacgctgcttggcttcttcgagctgacgggacagctcagcgatctgagcggactgctgctgagcggcggaaccctgctgctgagcagcggcgagctgacgggacagctcctcgttggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgagcggcctgctgggcctgagccacagcgttcttcaaaccagcattctccgactcgagttgctgcacctgaccggtaagatcggagatcttcgcattaaggttggtcacgtcaggacccagagtctgggtggcctgaccgccggctaccgcctgacgtccaagagcctcgacggtttccgtgacctgatcaaggaagtcatcgacctcgtcgacatcataaccttccttgaatcgaacagtctggaaggtatgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttgatgagccatgcaagaatgcggccgatcaaagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcagtcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccggtgagattcagtacgaccggaacaccgtcacgcaatgcacggccgaccagttgagcatcctcatatgacttcggatggatggtggtgattctgttcacacgaccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccggtagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatggccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggattgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggcggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccatggcagggccgagcctcccccgcgacgggtgaccttgggtaccgggcaaccgaagttcaggtccacatggtcggccatgttgccgtcgaccacgattttcgccgcctgttcggtgatggacggattcacgccatacaactgcagcgaacgaattttttcgcttttggcgaaatggcagagacgcagggctttcgggttgcgcgccacgagggcccgcgcggtgatcatctcggccacgtaaagaccatcgggaccgtattcctcgcagatcacgcggaacggccagttggtcacgcccgccatcggcgaaagcaccaccggggtcggcacggtaatgttgccgagctgcacgggggcgatgtataccggagtctcgggccgtgccggcgcgtccgtacgcgggtcgagattgttggtctcgtgagtagcggtgatggtggtttcggtttcagattctgccatgtggttcctgttctgaaatagttttggctcccctctttgaggggagctgccgccgtaggcgactgaggggagtcgcctcagcaagagcccccctcagtccacttcgtagacagccccccctcatagaggggagcctctatacagacccgtctttagtacagaccgccggcttcctgaacgccggactcaggccaagcctcgccgcccatttccacgggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgcttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcggccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaatttcgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccggctgccgggcggcagcgcgatgatgaccaagatcaccggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcggaatccgagattttggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcagatcatcgaggacaatgagaagtccgattccgtggcctttgtgatcgacgaccgtgccgacgtggtgtggcaggcccgccgcaagggcatcaaggtggacggtgtgcatatcggccagaccgacatggagccgcgagaagcccgcgccctgctcggcgacgaggccatcgtgggtctgtcggctgagaccgaaagcctcgttcggctcatcaacgagctgcccgacggctgcatcgactacattggcgccggccctctgcacgtctccaccaccaagcccgaggcttccgtgggcggcaacgacggctccggcaagacgctggacgccgcccagatcaacaccatctgcgctgccagcgaattcccggtggtcgtgggcggcggcgtgaccgcagccgatatggccatgctcgccggcaccaaggccgccggctggttcgcggtctccgccatcgcgggtgccgagaacccggaagaggccgcgcgcaccatggtcgaaggctggaaggccgtccgcggcgacaagaagcacggctacgcgccgcgcgtcgtaacccacacccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccacgactacaacaccgaaggccccaagtgcgacccgaaggaaggcttgaagcccctgcgtctcgactggatccgcgaccgcggcgacatcgaagactatgagggccgccgccgcaaccttgaggacgatggcaagcgcgccatcaagcgtggccgcgccaccaaggaatggcgtggacgcaagcatgagccgatgcgcgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccctgcaacatcaaccaccccgaggccgagccgatgattatcggatccgccttcctgaccaagctcaacgccaacatgggcaactcggccgtcacctcctccatcgacgaggaagtggagaagctgacgtgggccaccaagtggggcgccgataccgtgatggacctgtccaccggtaacgacatccacaccacccgtgagtggattcttcgcaactcccccgtgccgatcggcaccgtgccgatgtaccaggccctcgaaaaggtcgaggatgatgcctccaagctgagctgggaactgttccgcgacaccgtgatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgacaccaccaggagagcttcctgtacacgcacttcgacgagctgtgcgacatcttcgccaagtacgacgtggcgttctctctgggcgatggcctgcgccccggctccctggccgacgcgaacgacgccgcgcagctttccgagctcatgactctgggcgagctgaccgagcgcgcctgggccaaggacgtgcaggtgatgatcgagggcccgggccacgtgccgttcgacaccgtgcgcatgaacatcgagctggagaaggccgtgtgccacaacgccccgttctacaccctcggaccgctgaccaccgataccgctccgggttacgatcacatcacctccgctatcggtgccaccgagatcgctcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcggtggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacggggcttcaacggccacacatcatgcggcactttacgatagaaatccgtgccgacgagcaacacgtcgcccacatcgaacacctcctgacgcggaaatgtgagctgtgtggtgtgcccattaggcattacgccaaaatatgcggtgcgttcatcgtcaaaaccggtgatgcgtaccaagacgccgtcacggcgcagtacatcgttatcagccatgtcccctcccgaacatttcatgaatcaatcgcaatcagcaaaccctcccatctcaccacaggagcggcaaaacatcaaggaaaaccgctccgaaaaacatcatgggccccacttagaatgaacactatggcacagattgcaacatctacacttcccgctgttctcgcgatctccggctccgactcgtccggcggtgccggcatgcaggccgatctgaagaccatgctggcttgcggcgtgttcggcatgagcgccatcaccgcgctcaccgcacagaacaccaccggcgtgcgttccattcaggacaccaaaccggacattctcgccgaccagatcaacatggtgtttgaggatattccgccggtcgcggtgaaaatcggcatggtgtctgccactgacatcatcgacgtcattgctgaacgactcaccttccatcacgccacgaacatcgtgctcgacccggttatggtggccacttccggtgccaagctcatcagtgacgatgccattgcggccttgaccggcaagctgttcccgatggctacggtcgtgactccgaacattcccgaggccgaagtactgaccgatacgctgattcgcgatcaggaggatatggaggccgccgcccaccgcatcgtggagcgttacggctgtgccgcgctggtcaagggtggtcatggcaccgaggatgccaacgatgtgcttgccgagacggatggaaccgtgacctggtttgatggcgcgcgtatcaagaatccgaacacgcacggcaccggatgcacgctgagctccgccatcgcctcgtatctggcgcttggcgacacgctgcccaaagccatcaagcatgcgaagaagtatctgaccggtgcgctgaagacccagctgaatctcggccacggctccggcccgatggatcatttctggaagtatcgctgacataagtgtggttgttaagctccccttgccaggggagcttaacactactgaaaaaggagaatcatggttcttgaccgtaatgccgttactcaggaagtgccgatcgacccggaaaccggcaaaccgtacctcaacaccgtggcagccatccaggtgtcggccaatggcgtgggctccgaggtttcaccatacgtggctcaggccgtcgaagtgattcgcgaatccgccctgccgcaggaaaccaacgccctgttcaccaacgtggaaggcaatctggacgacgtgctcaaggtggccggtgaggccgccaagaagctcgccgagcagggctaccgcacttctctggtgctgcacatggatatccgtcccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctgcggaaaggcataatccgctaaccgccccatgggccaaataccgccccatgagtgttttaccgccccatgggaatcacggttctgccttctttcgacggggtaagagcgcaagtgtggcacatataggagcgttacaacctctgttatcgttcacgatgtgaccgcaatacggcgtgccacaaaatcgaacctatagttaagccccatgcagtgagctatctcacaacgattggctcgctacgtggaattcaagacttgggccgcaaacgtcgttcatcccacacaatgggagggcgaacggaacacgcagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggccgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggaccatcccccgctggtcctggcgtccgctgttcgtggccatcggcctagtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggcgccccggtcggctgcctgattggctctctgcttatcgaccgtatcggccgcaagcgcacgattgtgccggccttcctgttcactggcgtgttcggtttgatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaacgtgttgatgccgatggtggtgggctggatgcttacctcgcttggtaccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgcggtgacatgcagggcgccgttttgttgttctagtaattgtcggtaacggttgaggccggtgccggtggataggcctgcgtctccagcggacaatcagcgtctgtgatgtcacatgcaatgccaggagcggtatcaacggtcgaatcatgcggagtcactgcactgtgcgccgcttctcccctgccttcaatcacatcaatgacttgatgcgtgcggtccaatgcgcctagacatatccgtaaccagcacgtcaggccgcttggtggggctcaggcatcggctgatggccacggcacccaaatcgcaggtccatatcacggcaaaatcgctggacatgcgctcgattagcgtgccgaacactttcagcgcatacgggtcattgtccacaatgccgatgagtatgttgcggttgcgcacttctcccattacattcaccccttcagtgtgcccgacgccgaactgctccgtcctgacatgtcatggtcactatgacaactatcattccacatttcctgcgtgatttatgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcgtgcaatgatgcacgagccgatccaagcaaaggggccgaccatgagcgagacactgatggaacagtgccggttgcgcgaacaacataaacgtcgtaacgcttgtatcgccgccatcgtgacggtagtgcttgtccttgccgtcgccggcggcgtatggtggacggccggcgatggcagcgcattggttcgcaatatgttcaagccgaaggccacgcccgccacgcagccggtagtcaacagcaccgcagccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagatcacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtacgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcaccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccaccgctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgtcaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctctgccatcgtgctgtgcgcactgatttacggcttcttcgtcatcaagcatgatgatcaggaagtcggcggcgacccgttctacaccgacaagcagctgcgtcagatggaagcggccaaggcctgaaaggacagccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggccgctggcacgtgttctaccagctgcacccctacggcacccagtggggtccgatgcactggggccacgtctcctccaccgacatgctcaactggaagcgcgagcccatcatgttcgcgccgtccttagagcaggagaaggacggcgtgttctccggttccgccgtcatcgacgacaacggagaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgatcggcacgtgggagccgggcggcgaattcaagccggaaaccgagttccgcctgtgggattgcggccacaactactacgccccgcagtccttcaatgtggacggccgtcagatcgtctatggctggatgagcccgttcgtgcagccgattcccatggaggatgacggctggtgtggccagctcaccctgccgcgcgagatcacccttggcgatgacggcgacgtggtcaccgcgccggtcgccgaaatggaaggcctgcgcgaggataccctcgaccatggttcggtcacactcgacatggatggcgagcagatcatcgccgacgacgccgaggccgtggaaatcgaaatgaccatcgacttggctgcctccactgccgagcgtgcgggtctgaagattcacgccactgaggacggtgcctacacctacgtggcttatgacggccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggtttttttgtgcgccctgtcgttcgccttcgcctatactgatggacggcatataacacaatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggttggattcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccgcccggcgacgacgaagaccccgacgcggaccagtagttctttttttaccgtcaaaggcacgagccggcggccaggaccgactgaacgaagcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccgactcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggattacgctaacaaggagacgattctatggtccaatgtcctgaccgcattattgccagcatagatacgggtgttgatgatgcgttggcgttggcgtatttgttggggtcgacggatgagtgcgagttgggcggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagcttgtgtgcctggtgatgatatgtctgtggatgtgcccgatgaggttgtttctgttggcgggtatttggcgggggatgttcatgctcatccggcgttgggtgcttgttctcgtgtgaaccgctctcagtcggtggaccatccccagtcggctatgccgacagctctcgccagcgggggcaaaaggaggtgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcgggacgttttttggatgagtttgtagagaggatggctgaggtgtgccggtaactcccctcagtccgctacacgggcagctcgaccgcaattacggacaagctgccgctcgcattcttctggctcgactctcgtctcgccttcgcctacaaacagtccaccgggcgtttgctttacggctcagcccgtcagagggggcctaacaaggactatttcacacccccagcaattaaggaccggcttcgccggactcatcattacctggtcatgtcctatcggcctcggccaggcggcgtgaacgaacagtccaccggactgttctttatttcacgccgccaaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactccccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacaccgccggacgcgatggacaggtacgccggctccgccttgccgcataccacgcaagtgcccaatcgtggcgtccaaccggccaaggccaaggcgcgcatcacataggagtcgcctatggcttgcggggcgtgggattgtttggcgagcgcgttcaacgcgccgatgagcagccgatattggttcggcagctgctcatgttcggtgctggcgattttatcgatagtctcaacgatgacgttggcggcctcatacgccgcataatccgccgcgatcggagcaccataagcggcgaccgcttcagcttgggagaccacgtcaagcgagcggccttcagcgataagcacatcgactcgcatgaacggctcgagcctggcaccaaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttcccgcgacgcctggcagactctactcaatgaagtagtcagtaaataaacagaccccagaaggcgaacaccaacagtatgtacagcatggtgaaggccaccagccagaacaggattcggcccagacgggtggaggccagtaccgggtcagcaccggtgacgatgtctcgaacggattcgcgacgagggggtatctgaatcaggccgcggacggaagcggcttctatcaggtgcataaagacgcgggaccaagcccatagcaccagcacggacaccacttggatgaccggccagctccaatacatgacacccggcgtctcggtaggtgcgccaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcacgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggtgccggccaccttttcactggtctgcgtgagtccggcggaagtgccgacggcccagtcgatgagatcgtccacataggcgtccgcaaacggggtgcccgcttcggactcatctcccaagcgcagcacatggttggcgaccgggtagctgcgcacggtcacattccagttatcggctttgtgggcgttgtagagaatcgcacgcacaccgtcgacctgcgccgtcatcacgtctttcgaaccgtaagccacataggtgggtacggcgtaggcggcgggtttgagtgtggcgaggtcgaaattgttcagtccgaacaggccggtgtccgcgctgaacacacgttggacgatggattgatagccttcgttcgcgccaacaagggtgaagtcctgggtgacgaaaaatcccagtgattggcgtgggctgaacaccatcgggctcaggagaatctggaaagcgacgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccaaacgggtttgtcgagcactgcggtcacaaagccggccgaagccatatcagaggccacgtcgccaaaggagttgtcacaggtgccgtatccggcaccgtgcatgaacaccacgccggggcgcttgcctgatgcgttctgaggttcccgaatcaataccttgatagcttggacgccgtccgcattggccttgccccgagcaccggactccttggtcagattgccgtcgctggtcatgttcagcgtgatgtatcgctcggtgacctcatacgtgccttttgccggcagcgtttctccggacgggttatcgaaggtgacttcggtatcgtcggtgagcgtggccatcgactggccggtgggttcgatgttccaaggcaccgtggtcagattggaaatggagaccagcacgccaatcaggataatgaagatgggcaggctgaccatcagccggtgggtgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatttggcccttgccattgccggaggccacgccgaggtcggcttcgcgtgcctcgcccggaccgttgacgatgcagcccatgacggccactcggatcggcgcggtcacgtccttcaggccttcggtgacggcggaggcgagctggatcacatccacttgggcgcggccgcagctcgggcaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccctgccaggcggggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccgggccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggctgcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacaggcccagcgcgatgggcagacgcatgtctggcggcgaagcttggcaaatcgtggcgccgtccacaaattcgaccatggaatggacgatggactgcgggtgcacggtcacgtcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcgactacggactccttgttggccaatgccagctgggaaccggccttgagcgccgcgatcgacggttcgagtccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcggcttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacacgaaccggaatggagttcgtgttacgatccggcttgctggtgggagcaaaggagaccggcatagcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagcatcgggttcgtgagatgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccgggtatgctgcgggagcaaaggaaaccggctgttccgcattggtgctattggtgcttgtggaagcatcgaacgatgcaggagccgacgcataggcgatcggtgccgccgcggccggcgctgcgggagcaaccggagccggagcagtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcagtctgggcaggagccgcaggctcgccggacacgaaatcggccacacgtgcataggattccaagcgactcagcaactgcacgcaggcgttcaggaagtaatcgacctgtcgctcgtcataacctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcgcgctcgttacgctccgcatggttctggacttcgtgatacagcttctcggtcttcgccttccacgtcacacgcccatgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacagagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaagaccgaaattcacgattttgtagcagtactgcaagcttccttctgcacgcatctcattgagatttcagaacccttgccgaagactgtcaaggaatatcgtcacagcctatatccgtggaatgaggggattccacgaagtgatgaaaaaaaaatgaaagtgggcaatgagggactcgaacccccgacatccaccgtgtaaaggtggcgctctaaccaactgagctaattgcccgcaaatgacaacaatagcgtatggccggcactacgcgacacgtggtgtcgcatacgcgtgccgtagcgctcaatcgcaatgacattcagtcacgcccagcagcactacgcagcacgcgacgccagtcaacacgcttaaagtcaagcgtattgattgaggtttatcagcggcctttgccgaatgcgcgcaggcggatgccgttccagtccgagctgacggtcagcggggtggcggcgttcataccggcggtctgtgcggcggactgcacggtggaggagctggcggcacccggacggccgggcttgggagtcagtatccacagcgggccgtcattgcccagtaccgcgtaggcgtcaacgatcgtatcggacaattcgtcctcatcatcgccgtcgcgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcaccagaaacaacgactgaacgaggcgtgtcatgcctcgcaatgaggcaaatcgtcggcctgccccttgccgatggccaccaacgcctgatacgcctcgttcagcgtggcgaccttgacgtcgcgcagaccatccggcacgcggccggccacatccaaacaattcgacgcgggggccaggaaccatgtggcgccatcgcgcttggcgccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgcccagttcgtccgcatgggctttggcatacgccagaccgacggcactggccgaatcctgggaaccggccatgtcttgttcgactttcttctgatactggtccgcgctctggcccaccggtaccgtggcctcacgcggcatgacctccacctgcggattggaccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcggacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaatattgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatccgaagtccagcagatgatggccgcgttcagcgccggcggactcaacacgatgggcgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcgcccggcgatccggatgtgctgacccgcgccggctgggtggagggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgatgccgccgacgccgccgcgttcgaggctgcgctctccggattcgagaccaccgagaaaatccccgaatctgaagtgctttccttcctggccctgcaggaaatggctcacgcccgcctgtacgcctcggtaccgtggctgatgccgcgtttcgaggcgctcatcggcaagtacgcacgcggcatctccatcgatctggatgcgatggaggaacagctgcgtgacgccacgtcgatggatccggagtcgatttccggcgcggtgaatctcaccaaggtcggcatccccgacactcccgaacagcgcgaggcgctggcttcgctggaatcgctgctggcgatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggatatgggagatgatcaccgccgccgaaggccctgaaggccgtgacgccaagtggacgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagatggcgaagacggtgaaaacggcaactcggaggatacgcaggcatagtcaaccggccttcagccaattcccgctcctgaacgttcaggagcattcagtatgcattacagacgcccgtcacaaaaatcgtgatgggcgtctgcgctgcactccataaccatccttggtccgtgcatacgacaaatgcagcgaatcctcagctcgggtgatgcccacatacataagccggcgttcctcttccagcgcatcccccgtttccggcgaaccatacggcaagagcccttccgaacagccgatcagaaacacgtgcttgaattccagacccttggatgcgtggatcgtggaaatcgtaaccccgagatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaataccggctgttgggcgttgatgcgggtgagaatcgcgcaatcggacggcttggccccgttggcaaccaaccgggctatgcgtgccgccacgccctgtgcctcttccatatcgctctcataagcggttcgggtaacgcgcggaccggattcacgggcggaaaccagtttcaggtaatcctcacggttcggcgcggccgcaagcacccggttggcgaggttcacgacttccggcgtcgaacgatagtcggtgttgagattgacatcggcggcgagcggcccgaattcatcggcgaaacgcagcagatcccagctggaagcaccggcaaacgagtagatggtctgggccggatcgcccacgacgcatacgttgcggttcattgcgctcttgccgtcaggtcctcccccgcccagccacagggtcagcagcctgtgttgcaggggcgagacgtcctgatactcgtcgacggtgagccagccgatggtggaacgaatttgggcggcggcttcgggaaaaccatccatgatatggcatacgagcaacagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccaaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcggactcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgatccaagatgcctcaggcaagttgtacgacgtatacgccactaataccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagacccaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcggccgccgcctcgtcaacgaagcccggtttgccttccacaatcaccgtcggcgtgttaatcgcatgcatcgccaccatgattccccaatgatttcaagggttccccgatctcactattgtttcttccctaagaccgcctcaatcatcggcaccttcctggtggccaccacctccctgaccggcaacgcctcgctcggcgtgctgtccatcgccgtcctgctcgtcgcggcgctggtcttcctgctgctgcagaaagacccgacgcgaaactaactaatttgcgacgcgcaatcagcgctcgcgataatccttgaacagttggatggcgatggccgcgattccgcacagcacgccgccgataggccatgcgacccagaacatgcctgtaccggcggtcgaccaatcaccgcgcagagcagctgggctcaggaacagcaagcacaggccaatcagcgtggctatcatcatgatgatgccgcataccgcgccggtcagtttggcgtagaaatcctgctcgcccgcatgctccttgcagtcgtcctcggccgctttgttgtatgcgttgatattgagcagactgtatctcatgccgcagtagacaaacccgaaaacaccgggcgcacagagcagcagaaaaattgcgttgggccagccatcggagacgccgagcatgtcatcggcatacaccgtcaccgcaatgccaatcagaatagccgagatgccaccgacgatgccgattaccagcagccgcaattctcggctgcggtcctccccggtgtagaaatcttctacgtatgggtgacgccgtttgaagtcaatacgcgacagacctcctggaatcagcatcgccagccccgcaatcacacccacgcagacgcacagaaacgtcagaaaatcgttgagcggcgtcgctccgagaatggaattgctggaatcgaacaggttgccgatgccaaccccggcgacaatcgcagcaacaccgccggcaatcagcagcgcgaatcggcggcgatgttcatcgtagccagtgatatcctgcgcaagctccgcgataggagcgcttatgcccgccgttttggaagaagcggctaaaggcgatgccgtctcagccgaggagtcaacattcgacgaaccggccgcagaagccgacgcggcaggccgactcacatcgccaagtaccagatcatcaagcgtgcagccgaacaggtcgcagatcataagcagcttgtccatctcgggataggccttttcggattcccatttcgaaatggcctgacgcgagacgccaagcaacatggccaatcgttcctgggtcaggttgcgttgcgcacgtaggtactgcaggttagcgcgaaaactcattggaatgtcccttcatacgtaatctttatcatgtcatgttcggccgatgggctcactatggcatgccgtccatgtcacccgccaccatctttgggttgcaatcgccggttattcgagcgcaaccacaagttgcatcggcggaattccgccattccgttgacctgagcagctttaacatcgcactccacgagaccgaagcttttccagccatgcgagggcagcttgtctcacctgccaccacgaatccgcttcgacccacgtacacatctgtgtgcagcagcgctcgcaatcggttacctacgacccatatgatttgctgagcgaccgcaaaacacgcaatagccgagacaacaccgtcagcgttaaagcttaaggcgactacttgcccaatagtccggaaatctggctgatgatgtcagcgggcagtcctgcttgttcggcaatggatccgaggtccagattggcaccctgctcctgaattgcgccagcgacctgactgatctggtcggcggagatgttttcctccgccagcgcctgcagctcgtcaagtcggtcggcgttcaaatggtcgccaacgacctgttgatttcacccaactgatcggcattgaaatgctcaccgattaccgccggcaaatcaccaatcgaaccgagattgaaatccccgccaagcacattgcctagattgtctgcggcaaaatttttcaggctatcgaacagtcccacatgtgccgctggtactgcttgttcagcaactgctgcagagcatcgcacagaccctgcatcaatcgccgctcttcggcagacaagtcccgcgtgaaaccaatctctgcctttgcgctcatcagctggggagctcacggtccgctgagcggcaacaggtgaataacttacacgcatgtccggattcacgcaaatcaggcgcacgaagataagcccaaatcgttgaaacgacaggcttcgcccggcgtgtcgcaaacagcctatttgcgctgttctgatatcagaataatccgttttgcattgccgatgcgtaacaaattcatgtgttcatcggcgtgttgcaagaattcgattgcgtgaccatccaggttcaccttctcgcaaccggtcatcgcatatgcaaaaagggacttccctttacgggaagtccctttcagtagctattgaagctcgctagcttcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcaatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcggctgtctgccatcatgctcggtcttgactcattatttatccgtgcatgctgtaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaaaccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcatgcgttccgtagagaacgcttcgccacggcgaaaccgccaagtcgttatagtaacggctccggtggattatcgcaaatcgcgtgtcgcgcgcgtggcacgcgactcttctcagttagcccattccttgaatcgacgcatgccttcggctaggtcttcgtcagccagtgcgtaggagaaacgcaggtaaccgggagcaccgaaggcctcgccggggacggcggccacgtgggcctcatccaacagtgcggcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcttcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccaccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgcttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccctccacatcagtgatctcgtcgatgtactgctgcttgcgggagcgtcggaccagcggctgttcgctgttctgactctggtcgtcggtgccctcgccgttcttgccgccacgacggcgacggcgacggcgagtaacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcatcggaatcgaaatcatcatggtccgtgttggcgctggcattggcgtcaccggcggcagcgttgcgggaagcgtcacgagacgcatcacggtcggcggcattgcggccacgatcgtcacggtcgtcacggcggcggctgcgcggctgcgcgtcgtcatcatcgtggctgcgcgagcggcgggagcgacgcgacggacgttcgtcgtcgtcaacatcgtcatcacgagtgtcagcggtatcgtgcgcatccacagcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggacggtcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgatgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagaaaagcgtgccacgtcggtccagccgagcttggccagcgggtcgcggccagtgcgctccttaaccagccggaccagatcctgggcgagcggggcgttcaggcccgggcgcgcggaggggctttcgtccttcatttcgatgccgtagccctcgaacacgccgccggtggccacatgctcgccattgccgagttcggcaccggcgtccgcgcccatcatcagagccttggcctcggccagcgacttgtccggggcgaagcggtagttgacgtgcacgcggcattcatccggaatgacgttcgtgcctttgccgccggagatcagcgtggcgttgaggccctcgcgatagtcgagcccgtccacgttcacggtggccggctcgtaggcgttgagtcggttcaggatgtcggccgccttgtggatggcgttctcccccatccatgcacgggcggagtgcgcggccacgccgtgggtcacgacgtcgaagcgaatcgtgccgttgcagccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtctccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgagatgcccggccaagatcacacggctcggcttgccgaagtcggtgctggccaccactgtgtcgccgtgacggcggacggtcaggtgctcttgttcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaacgccccggacgccaccatcggcgcattgaactcgctgtatctgaactccaacaacatcggtttgccgatcgccacctatattctgggcaacccggctctggtggcaccgattctggtcatgcagcaggccatcttcacaccggtgggcctgaccgtgctggacgtgaccaccaagggcaaggtctccatcaaggaaatcgccaagcagccactgcatcaaccgctgcttatcggttcgctgctgggcattgtggtctctgcgatttccgctaaaagcggctggttcccagtgccgaaattcattttcgacccaatcgacatgatcggcgattcagcggtgccaatgatcctgatggcgttcggcatgtccctacacggcaccaagccgctgcagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacacgagcgtcagaatgccgccggtgccgatgtcgcgaatgaacacggtgaacgggtcgttggcgtcatcgaccacggcggccgatccgaagaatccgcagatcgacgtgatgccggcgataaacacggccaacgcaatgccggacacattgcgccaggcgcgcttagggttgtcgagaatacggcgcatggcaatcatcgtggccgcatccttggggcgcttggccttggccttggcgcgagcggtgatcacccacgtgccgataagattcaccagcgcgaagcacagcagcatgaaaccgatgatcacgccgtacatcaccgcctggccggcctgagccagcatggccgggttcttgaagacgatcatggccaccaccacgactaccacgaacagcaccatacgggtgcctgagggcaatgcggtggcggtgcgcgaggtgacacccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcagctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccgacggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggctggctgggatggctggccggcctgaatggcacccggtccggccgcagcgggattcgccgacgcataaccggctcccgtgccggctggtatcacgccggtgacgccgtgcccggcctgtgcgcgggccatgctggcggtgtagtccatgaccaggtcatgggcctcgatgaccggggcccactgctgggggtgcgatgccggctgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggatcaccggcccgctcctcatccgcaaggattagagatacgcagtcgacgcgacaatccatatatcagatgttcattgctcgagaagacgaggaacagtggaagaccggttcgggagctggaaccacataggccggttcggctggatatgcgaatcgcacgcacggtatgttcagggaaccagcgcgctgcgcgcctgtacatcgaacagaccaagcaaaggagcccacatggccatcgcaatcgacatcccgcacacaccaatcgtgtccgtacaaaagtcgtacaacaggagtatgactacagagaataacaagaacagtcgttttgaaatgagactcacctaagagcaacgttccagaatcgaccaagcggccgagtccaaaggcatgacttcgttgcaatgggcattatcgaatctgctcgccgccgcagatcgggacatccatgaagctcatatcattcggctcaacagtaaagcgtggaatgatttcaccgcagcattaaacgaacctatgggcctacgtctgaatgaattgttggagcgtgatcccatatggacgtgaccaacttcactgagcctcggcacctgactgcgagcgaggatatttctggtttcgactgcggcctgccattggtcaatgattggctggtttccacacactaagtgcatacagcattgagcattcggaagctcccggttggctgaggcgaaatagtccgaaccccattcccgtaattttgctaggcatgatgggcgtggatatcagatttcaaaccatgcacgtcgacagtcagttactccgagatgcggtacttcattctctgaacgatatgattttcggcatatccctgaatcatctagaatgtttactccgctcaatgtccacaatcaccaatgattaatggctggagaccgctatttgacgccgaccattgtctgaatcgcattcagacacaacactcctcattgcgcgcagaccagcgagttccgccgagtcggcgatgtgtctcttcggcggttgatttaggattttccgcatgcgacagctgaccacaccgctaaaaatgccattttcgcactgacttggggcggaggtcgtggcgaaacgcacgaggaaacgtgtgtcatccgatatggtcatgcccgccaggcattgaagcgtcctgtctatgcgcggttgatgtcccggtggcggggtcaatcgatcgacatacgaaccgggacagattcggctgtcccggttcgggatttcggcctcttttggcgaaccgggacaggcccttccatgaacacccgatatatgcaaatccaaaaccccggaattccgccattccccgacggcgaccatcgcacgatagggcgtcaggtgaatgagattctgtcccggttgcccaaaaagaggcaaaatgacgaaccgggacagcgaaatctgtcccggttgtcccaaaagagacgaaatgacgaaccgggacagcagaatccgtcccggtccacacgcggttcacacggcattacccaagtaaactcatcggcaaaacattggcccagccaacaccactaccgatgtccagcacaggccagctcgtccaggcgggcggcgaagcggggccagtcggtcttcatagcggtgaggagcttgcggttgggcacgtcgtcaatcgggacccagcagatttccatgctttcgtcgtcgtttgcctcgggctcgacggtgtggccgggcttttcgaaggcaaacacggtggtgtaggcccacgggccgtggtcctcgcggtaggagccgactacctcgatgtcttcgggagtgatgttggcttcctcatagctttcgcgcagcgcgccctcgatgggcgattcgccgtccgcggtggcaccgccgggaataccccacgtgccgccttcggcgctccacgcggcgcgatgttgcatgaccacgtgggtcaccttgccactcaccgggtcgcgacgagccagcagaataccggaagcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgactgtcgcctcggtcagtcccggctgtccggcaatagcggtggcgatgggttcggtgacggtcggcatatcgatgccggagaagtcgcgcgtggtggcgatttccgccttggaatagtcaatgggcttgccagcggcggcttcacgcaagtcttcgacggcagcttcgcgttccgaatccttgatttccttggccttgagcgggtaggcgatcacgcggtcaccggtcgcagcggcggcagtatcggccacatcacgatacgcacgatgaacggcctcggccttggccgcggccagaatcatcacgcgctgcttgatgctcaaatcgtcgacggtgacgccttcttcacgggcggccgcttccagcgcagcaggctcatccacatgcgagacgcgaattgtggggcagatacccgccgaatacagcacgtcacggcgaggcttggacttggaagcaagaattagtggaatgggcatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcctagacggtgtcagtccagcacgcgcaggatggacgggtcaccggtgacgaagtcgagcgcctgcacggccttgacggtgttgcgcagggtttcctcgtcggtcaggtgggtcacgatgcgcaactgctgaatctcgccgtcgtagccggggtcggtcatggtgggcttcagatcctggttcacaccgttgatggagacaccgttcttggcgaactcggcggcgatggcggccagcacgcccggcttgtcgtggatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgctcggcggtggcggcggcgatgtcgtcggcggtgatcttggtgatgccttcgacggacacgtcgtcgatggtcatggaggtgtggaagccgagggtggccatgatggcggccttgttggcagcatcgtagccttcgatgtcgccggtcgggtcggcttcggcgtagcccttggcctgggcgtccttgagcacgtcgtcgaactggagacccttggtggtcatctcgtcgagaatgtagttggtggtgccgttgacgatgccgagcatgctggtcaccttgtcgccgaccagggactcgcgcagcgggcgcaggaacggaatcgcaccacctacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggtccttttcgtattatgacggatttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccgccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggctagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagccgtagcggccggccaaattggagaaatgggcataatcacatcttttcgggggcggtgacgccgaggaggtcgaggccgttggcgatgacctgctggacggcgtcattgagcttcaggcgggcggcggcacgggccggctccgggttcttggcaatctccaaggccttgcgagcctcgtcgtcgccacgggtttccggatcggtcagggccatcggcaccacgcgctctacgttgtaccacttgtgataggtggcggccagttcttcgaggtaacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcggcggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtccgcgccaagcatgtagatggccacgtcggccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcatcgttcaggccctgatcttggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcggccgtattcgttgaccttgttgagatgcttgtcggcgtcggtcacggcaccggcggcgagtacggtgtccaccacggcggcggccgaggcggagtcaagcgtgatgttgatgaagccggggcctgccacctcgaccttggcaatgccgtcagcttcagcgagcgcggcggcgaacggctcggccagatcgcgcggcttcatgccggccttcttggccagctgcatggcgatgttggaggcccagtcgccatgtgcacggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgctctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacactcaccccgaggtgacgcgcacccgcatcctcgacgccgcacaacggctgttcatggcccagggctatgagcacacctccatccagaacatcgtggacgagctcggcgacctctccaaaggcgcgatctaccatcacttcaaatccaaggaagccatcctcgaagagctcatcaaccgagacaacaatgtgcaggacgacttcaacgaatccatcatgaatcgcactgaccttaccgccctcgaaaagttccgcgtgctatggcggcattcgatgaccgagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgccgagctgctttcgttgctgccgaattattggctgatgccgtatttctacccggcgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatatgatgctgcgattcgcgatgtcgatgtgggtgctggacaaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtactcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcggcgccccggatcgcggcgacgaggagctgcccaccccacttgaagacctcaaggcaggcgtgcgattcctcatcaaggaccggccgaacgtgttcagactgctgttgttcgcggcggcgctcaactttgcgcttatcggctattccggcgtcggcttcccgtacacgattcgtacagtgctcggcttcgacgccactgtctacggcatcgccgacggcctgatcggcgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtcttcgcctgcggcacaatggttgccagttgcttcacgaatctcatcgccgtgcccgccatccagctcagcacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcccgccgcccggccataattgaatcactgcacgaaaaggcacgaaagaggtacctatggccacgctcaacccccaatcattggtcacgttgtggcaaatcgaacagtatggttcgttctccgccacggccaaggccacgggttggtcgcagccgaccatcagccagcagatcaaaaagctggaggcacagtgcggttcgactctggtgcaacgcacctcgcatggtgtggaactcaccgccaccggttcgatgctcgcccgccacggcgaggccatcgccgatcggctggagcgggcggaccgtgaggtcgaggattatcggcatcatcggtttgctcacctgcatttggtggccccaccgtcaatctgctctactatcgcggcccgtaccgtggtcaagctcagtatgctcacggacatcgagctgagcctgattcagatggagccgccggaggcgatcggtctgatttcccaaggcaaggccgatgccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggctactgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccacagcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgtcactgggcatcgacgacccggccaactatttctttaagaaggccaacgtggcgttgacagacggccgtgaatgcggcgaggtcgggcgcggttgcgtgcgtatgaacttcgccatgccctacccgctactggaggaatgcttcgaccgcatggccgccgcgctcgaggcggacgggctgttgtagaaaattgtggctcccctcagagaggggagccgaggaacggccgaattaatcgaagtcggcacccaacgcttcgagtttgccgcggaagtcggcgtagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcaatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcacccatcttctgcagcacgcacaccagatccatgatctccggctcagtggccgcgcccgacagttcggtcttgccctcggccagcacggccgccagtaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggcgttctccatacttctacgctacgattcagggcaatggcatcagacgccatgtccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcggccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtgggtgccgtggccatgaaggcggcggctgagtaagacggctgtactcaccgcaaaaagaaaccccggcgtgatgggcgccggggagagaaaggagagaagaagaagaaagaggttaagttatgcagcttgttcggccgtgattacatataacagcaacaggttcaatgcaacatgggcactgtctgggaatcgtctgggaatcacggcccgtacaggctgttgcttgtttttggagccgatttaccggctggccttgatcttgtgggccagttcggcgtcccacatcgcgccggtggcggacatcaccgagtccgcgccggcgtcatggtacgcctggtagtcggcgggcgagaccacgccgccgacgccgttgatcgcgaaatcgagcccgagcttttcacgaatcgcggccagacgggcgaccatgtcgaggccggcaccacgaatcgcattgccacacacgccggagcgatcacggcctgcaccgggcagggcctgattgccattggcatcgaccagtttggcggaaatcgtattgatggtgctgaatccctgcacagtgccgtggcccacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtttctttgatcaggcgggcggtagtggcatggtcggcgatgtattcctcctcgctcatgccctccacacgcgagccttggaagctcgggaccagcacttgaccgggaccggcggcctcgatggcggcgcgcatgtccggctgccagacgtcagggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaagcccatgtggaaagcggccgtggtgaaacggctgttgagcagcgggcctgcgggaatgccgaaaggcagattgaccggctggcccaaaaaggtggccaaggcaccctcggaggcaccctcgctggtggttccggcggcatcggcaccgttgccatccttcagcgcctcggcgaacgcgccgaacggcccttgctcatagttgtcttcgtaactgcggctgacatcgtaaaacggctcaaaatcactcatgcttcaacgataagccaacctgcatgcgcacacgcacactcaacccatcatcgcgccgacaaacgaaataatggcgaaagcggcattggctaccacaaagatgatgaacgtcggagctgcccagccaaagtacgtgtctggaatactacgattcgtacggtgatattggcgcaaacttaaatagtgcaaacacaccctagaagagataggagggaatggcactttctcgcgttgttggtggaagtatttgggatgctaagcgagttgccgcattggaaccagacgattgcgtgaagtgaccctatacgtaaaaggtctcactggcgagagccagtgagacctttgtctgatgcgatgcgagcgacccaataatctcaatcagatacagagccaacggccctgggcctgcaattatggactcgcctttcggcgaggctcaatgctggcctcgctgctgtcgcagctcggcacagggcctgctgaaagcccaccgggctttcagcaggccgatcgcggctaaataatgccgcgatcggccaacggccctgtccagtctgcgtcctccggctcgcgggcggactcgattctttcttcggcccagtgtttggcggggatggtcttgggcttgaaggggaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagagggggctcacgtgtattgactcagagatcggcgggagacgagattgtgccgcggatggcggtggcggcggctacggccggcgacgccagatgcgtgcgcgagcccttgccttggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggaggcggtgatcggcagaccttggccggggttggtgccccacgtcacatatggaccgagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatgttgcacacggtcatgcgctcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggatacgactcgaacatgacctagtcatgactcggttccgctccagacatgtctcttcggcatccacgaacgccctttcaacttcatggccaccctgtgagacacttccccaatttgctatttcactatgtgagatggcataatcgcccttattatgactgattcccaagaagagccattgaacaacagcttgaccgagtccgagccggttgaagacaccaccgccaaggacgatggggaaatccattccggcgttggcgtccttgataaaactgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgagcgcgaagagggcgtgtgctcgatttccgccccgatccgcaacgcctccggccaggtcatcgccgccatctcgatttctgggccgaccggccgcatgggcgccgctcccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatacacagcggaaggcccccgaaaccccgaatacttcgcgccgcttcccgcctctatcaggaacagttacctgaataaaccggacagttgactccatagcgacggcttgcgcagcaaatcatcgccctcaccctcgccaggcgtggtctggttcaccgcataggtgtaggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagatcctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaaccagtggcaccagacagcgtctgcacagcaccacccgctccacaggtatatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccgttcccctacatttccggcggttccatcaacctggccgtgattgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgctgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctgcgccgctactgccacgtaggcaccggcaactacaacccgaagaccgcgcgactgtacaccgatctgggtctgctgacctgcgacccggtggtcggccaggatctgactcgtctgttcaaccagctctccggttacgcgccaaagtccagcttccaccgtctgctggtggccccgcgcaccgtgcgcaccggtctaatccagcgcatccgccgcgaggaggacgccgcccgcgctggcaaggaggcctggatcaagatcaaggtcaactccatcgtggacgagaagaccatcgacgccttgtaccgtgcctctcaggccggcgtgaagatcgacatcgtcgaacgcggcatctgcgctctgaagcccggcgttcccggcctgtccgagaacatccgcgtgcgttcgattctcggccgcttcctggagcactcccgcatctacgccttctgcaacgcggacggcccgcagatcggcgagggtccggcttccggcccggaggtctacatcggttcggctgacctcatgcaccgtaaccttgaccgccgtgtggaggctctggtgcgtgtcaccgccccggagcaggtcgacgggctcatcaagtacgtggacctgcagatggccgactccaccatgagctggcacatgcagcccgacggcacgtatgtgctgcacaccaaggacgacgagggccgcccgctggtcgacagtcaggaatatctgattcgcaagcaccagcgccgccccaattcgcacaactgatttcattcgatgctccctgtcagcacgagctgactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcaggcatcgtctccatcagcgaaatccaatattgccaccgatggcaccatcatcgcgaataccgcggattctgacggcaaggccacggcagcacacggcgcatcggacgcggcttccaccccggacccggcgcaggccgacagcccagccacagcggacaacgtactcaaccgcatcgaactgtgcatcgtgcatcgcccgaaatacgacgactggagctggccgaaaggcaaggtcgacccgaacgaatcgcaccggcatgccgccgtacgcgagatcggcgaggaatcgggcctgtccgtggaacttggcccctatctgggcgacatcgagtacccgctgtccgaagaaggcagcaaacagcgccataccaaggatcggtcggcggataccaagcatatccagttctggatggccacgccgatcagcgccatcgacaacctgcggcgtacccatgcgtttggcccggtgcatcgggcggacatcggcgaaatcgacgaagttttgtggctgacgccggccgaggcccgcaagaagctcagccattccaccgataaggacatcctcgcgctattcgttgatcgggtgcaggagggcgcgcttgacgccgtgccggtgattatcgtgcgccacggcaaagcggaagcgcgcaagctgtggaagggttcggacgcgaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcatttcctgattcatccaactcctcggccgctgccgctgcagctcatgccgcgcacaatggtgccgccggcagtctgggcccgggcttcggctcgttgcgtgcggccggagcggcattcggacctgctcgcatgggttcttcacgcccctcgcgcccggctcagctcgacccggctgtggccgatggattggccggtggcatggacccgcaggcgttgagcgagatgagtcatctgtctgctgccgcattgctggatcgtgtgcgccatagcgaagacccggcggttgttgagcgggtgctcacgttggtggagacggtcggcgtggatgaaatcgccgaactatggagcgataccgagccggattcgctgcctggtgtgctgtggcgactgtatatgttgcgtacgtggatgcgatcgaatcgcgactcgatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgtgcggcggcgtttaccgatgtggtggcgttgggcttgcgcgtggaggcgcggcgcatggtgacccgggccgaggccaacggcgccttctcctcggatgccgatgagaaggccgtgcgcaccaaagccgcccgccttatgcacaccgccggcagcctcatggccaccgccaaggatttccaacacggtgccaacctctggcgtcgcggacggttggagtaaccccgctccaggctccctctgatgagggagctgtcacgggcgatgcccatgactgagggagaaacccaccgaccgcaccccaacaatcagctaccagccaacaccacacctcccccggcgcggcgagccccatcgcaagctatactaagtatccgcgtcggaccgtgcttaagccccgggctccattttttgccgccgcgagcggcccttgcgccgacaggcgctttcgcggttcggcgcttcttttcttttacccgattcacgccccgaacgttgcgatgggcacgaccagtatgccgtcattgcggcgataggccttcccacctcggccggtaaggaacatcatgaactctggttcgcgaacttgggccatggggttgccacagattttgtcgcggaaggatttgagcttatccgcattgtcatcgttcaccttaaggtcactgagttttatttcgatagcaccccacctgccgtcagacaactcgataatgacatcaacttcaagccccttgtcatcgcggtagtaggcgatgcgattgttcgcgcccggcatggccgacagatatacattcaaatcacgaatgcacagcgtttcaaacagatcgccgagcgtctgtgtatcgcgcatcagagtattcggcgcggcacctaaaaccgcagcagacaacgaaggatccacgaaatatcgcttgggcttggttcgcacacgactctttgcgcggagtggcggctcccaaccctccaaatccgtcagaaggtacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccatccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacgatcaacgcttcgagaccgggagagcgcggtccatgtcttgccgcaccatttcggcccaacgatttccactgcaccgaacgccttgagcagtttacttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatcttattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacggcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcgacggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacacggtccgggaccatcggctcatcggccgggttggccgcgctggcatcagcagattcagcatccgcgctctccgcggcggcaagctccttctgaatggacggaatctcgccgtacagaatcttcgaggcctccgccaagttgccttcacgggtatacttatccgcctgcacgcgcaggtcgtcgagcttggcacgcaggtcgccgaccttgttgtggccagcctgttccgcatcccaacgcgccttgagaccgctgagcttctcacgggtgtccgcaagttcggcttgcagcttgcccagacgctccttggacgcaggatcctcggccttcttgagctgcatttcctccatttcaagacgggtcaccttgcgctgcagctcatcgatctcctcaggtgaggagtcgagctccatacgcaggtgagcggccgcctcatcgaccagatcgatggccttgtccggcagctgacgacccgaaatgtaacggttcgagagggtcgcggcggcaaccagcgcgtcgtcgccgatcgttaccttatggtgcgcctcgtaacgctgcttcagaccacgcagaatggcgatggtgtcttccacgctcggctcacccacgaacacctgctggaaacgacgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctgaccatccgcattcttgatttcgttcaggacgctcttcaggcgctcctcgaactcgccacggtacttcgaaccggccaccatggagcccaagtcaagggagatgagcttcttgccttgcagggtggtgggcacgtcgcccgccacgatacgctgggccaaaccctccacgacggcggtcttgccgacgccgggctcgccaatcagcaccgggttgttcttggtacgacgggagaggatctgaatcacgcggcggatttcctggtcacgtccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggatccggatgcgctcggcagcgcgaccaaagcgttgcgcaccgccgcgccgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcaccgtgcacctgcggggtgcagcgcagcgagtaggcgtcctgcacacgcacggtggagcccgggcggccggcctcaatcagaccagagtccttgagcatgcgggcgatgttcgcagcggaatcgccttggccgcgatgcgggcgcagcgcctgcaagtcggaggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccaaatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcggatcaggcttttctgcagttgcgcgcgctgttccttggggatggaagtggaggcgagcgcgccgaatccggtggagatgccgtaatgcggcacggtgtcgtcggccagatgatcgataaccgcgcgactcagcgccatctcatgcttcgattcgtccgaaatcgccactttggcaccgccgcgcgctacggcgataacgtcctcgatgctcaatgccccaacgcctacggtgaccgtctgctctgccatgttttcctacctctctatcgtgctgagctccacttggtattggatatattcatctcgccagcatggcatatcaacgttacgggactgtccacaatatgcaccgccccgcgccagcgccgcgcgaacgctcctatactcacggctggtttgttatgcgcctgaccgccgccggtgctgcggcgggtgcttgtgggataagagaagaacatgatttttcaggccggttcgctgctgctcgttatcatcggtgtctacatactcaaacatgtccacattttcggcgagcgtgattacaaaatcgtgcagggtctggtattcaatctgacgcttccttgtgcgattatcctgtcgttcgccacgaacaagcacgacatgcgcatgctgtggatcgtgttgttcggcttcttcgcctgcgcgattccgctgttcatcgtgtatttcggttctcgcggcgacgagaagaactaccgcgccttccagatgctcaacgcctcgggcctgaacctgggcgcgttctgcctgcctgtggttcagacgttcatgggcccgtccgccggtctgccgatcatcatgctcgatatcggcaacgccaccgtggccacggccgggtcactgaccatcacacgcacgctgctgcatatggatgacaatttcaagtcgctaccgctcatcctgcgtctgcgcaatattgccagggacttcctaagctcgatttccttcgacatctacatgctgatgctggtgttcatgttcctgcacatcacggtcccacagcccatcgttacgctcatcaccccgttcgccaatgcgaacgccttctgcgcgatggccatgatcggactgatgatggagattccgaacaatcgcaaggacaaggtggagttgggcaaggtgattgtctggcgcatggtattcggcgcgattatcgccgtggccgcctggctcctactgccattcgacatgaggattcgcgagatcatcgtgttgggctcgttcgcccctatcacgatcttctcaaccaagttcaccgattcgctaaccggcaacgccaagctcgccggcttctcgctgacagtgacggccatcatcagcctggtggtgatgaccgccctgcacgcacttctgccgggagcgtaaggcgcgttcttggttccctcagtcagcttctccgcctggacggttcccctcagagaggggagccagaacgagtcacgcccgaacgattacgttgcgcagatcaccgatgccttcgacgtgcacgatggtctcgtcgcctgggtcgaggtggccggaggcgttcggggtgccggtcatgatgacgtcgccaggcagcagcgtggagaacgacgaaatggcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcggacaggaggtatcgaagcccttggcgcgcgtccacgtggggtcgatgccctgcagatcgcgcaacgtcacatcattgacgcaggtgaagccgagcacgtaatccatcgcgttctcgacggtcacgttcttggcgatacggcccatcaccacggccacttccggctcgaagttcatgtccttggagcaggccgggtacacaatcgggtcgtcggggccgattaccgaggtggacggcttggtgaagatcaccatgtcttccggcgcgtgggcgatttcggagtggccggcctcgtgcatgaactgggcgtgggcctcatagttcttggccagaccgtaaaccttggaggggatgaccggggagagcagacggatgccatcgccgtcgaccgggtaacgagtgccggtgggcttgacctggtcgccggccagcggatggccgtccagttcgatgaggtagtccttgccgtccgtttcgtccttctgcacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcggcggtatcgcctagcgaggcatagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtatagcccataatcgccgtcggttagatcgtcatgggtttcgcccaacgtgtcgtccagcgcatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccagaccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccgaagccgcccccggatagggcgaattgggtgctgccggtgcgggcgcgggcgcagcggcaggagtcactggtggcaaagcctgcgtaggcggtaccggctgattggccggcgcaaaaggctgggtgggctgctcggcaggtgtaaacgcctgcgtaggctgctcaacaggagtgaacgcttgagtgggctgttcgcccgctgcgattgcttgggttggagcattgttggcggcggttcccgtttccgccgtcatcgcatttaacggctcagtcggattggcgtcagcttgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagtaccccaggaaatttggcttccaaaaacacaaaagcctgaaaccggctattgcctcagcaatattcagtcggtttcaggctaaatcgttaatcctctggcgaaacgacggtctacttcttcagtagcggtgcgacctgctcctcgtaggcggtcagggcggtgtcgattacgttgtgcatgtcgtagtacttgtacgtgcccagacgaccgccgaacacagtgttcggctcggccttggccttggcctcgtactgggcgtacaatgccttgtccgcatccgtgttgaccgggtagtacggctcgtcgccgcgttcggcgaaacggctgtattcctcccataccacggtcttgttcgggttctgggcatcgtggcgctccgggttgaagttcttgaattcgatggcgcgggtgtagggtacgtccgcgtcggagaagttcatcaccgggcaaccgaagtggtcgccctcgtcgtaacgcacctccttgaagtccaccgtgcgccacttcaggtcgccaagctcgtaaccgaagtaacggtccaccggacccgtgtacaccaccggcacgcccgcggccttcagcgcctccttgttgtacggctgggactcgtcgaagaagtccacgcccagcgaaaccgtgatgcgcgggtcatcgatcatgcgctccatccacttggtgtagccgtccgcgggcaggccctcccacgtgtccttgaagtagcggttgtcgtagttgaagcgcaccggcaggcgcttgatgatggccgccggcagctcggcagggtcggtctgccactgcttgcccgtgtagttcttgatgaacgcctcgtacagcggtcggccgatgagctggatgcccttgtcgttcaggttggccggatcggtgccggccagctcgcccgcctgcccggcgataagcttctgcgcctcggccggcgtgtaatgcgcatggaagaactggttgatggtgcccaggttgatcggcagcggatagacctcgccgtcatgcgtggcatacacgcggtgcacatagttcgtgaagctcgtgaaacgattgacgtagtcccacacacgcttattggacgtgtggaacaggtgcgcgccatacttgtggatctccgcgccggtctcctcatccatatacgagtaggcgttgccgccgatgtggtcacggatatcgatgatgcgcacgcgcgcgccggtgtgctccaccgcctgctgcgccaccgtcaggccaaacaggcccgcgccgacaattaccaggtcggggtattcagtagaactcaccatgcgcaataacctttcagtgtcaatctatcagttattatgttcgatttccgagagattatcttactcacccaactgcaaatcgaccaaagagcaatgaacgcctgcacagcatatctatatctgtttcctaggaacattcgcggagcaaagatcaagcacgcccgcgcaagcgccaaattgtgtaggcggcgagggtgatgccgtctgcgatgctgccagcggcaatcatctggtccatagtctgtacggagcaccatgtgaggtgcgacagttcccagtcatgtcccgcatccggcgtcacttcggaaacgttcagaccgaccacggcaatcgaatctttcatcacacccgtgtccgcatgcatacgttgcaacaccgccgcggaatcggcatccgcatggagcccggtttcctcatggaattcacgcaacgcggtttgctcgggtgtctctcccggctctcccatgcctcgcggaaattcccattcccatgattccgtggagacccgccagtggcgagccagcagcacgcgcccatcacgctccgcgacgcatactgccccaggacgagcacccttgaccgaagcataatgcacggcgaaatgattccctgtcgcaacgtcttccagtgccacttgggtaaccgcaaaatcggcaccgccctgctcttggtacatgaccttcttacccagaacctttagcggcggttcgccgtcatgtactgcgtcatcgcgaatcacttcgtcagccaccgcgccattggatataacaccgctcgatgccccgccatcgcgccccaccggtaacgcattaactaccatttcggcccctgccactttcgccattgattattatccattattcaccaaacgccactgccgcgaatagccccacgttccgcccacgatccacccacctaatccatggatccatagcagtgcgcacggccggtaacccgcggtctgcgaactaccgcgcccgcagcccacactactccaaatacaccacggtcttaaaactcgacctcacacccagcagccatttcgcgatatcgataagattcggcacaatgccgatgaaccacgccaccatcaccacgagccatatcggcgatttaccgttgaaccacacgttgtccgacaacgcagaaagcaatgccaacacacccgccaccaacgcactccataacatatctatgccgtcacccttcaggctcttctgctggcacgcctgctccaccgcataggccacattgcgcgtattaatcttctgaattcgcttgctcgtatcggcattgcacttgcgccatgcctcaataaccggctggctttgatagcagaacgtcgcaaacagcacgaacggcatcttgcccaactgcttggtaatactaccgttaagtaccagcgacgacctgctcgacctgtctccagccagccgtgcaaatgagttattcggcgcgctcaccgctaccaaatacgcgccaagatgctgcgccatggttttctggtacacgaactgataccagtctcgcaacaactgacgagacatttcaggcttctcgactttgcctactttgccgaccgacttaccgaaccatttgccagtcgacccatcaaccgactcatcaaccgtctcttcatccgtctcggtttctcgcagcgctggcttgccttccggcagttcaaccgccctatcaatgcacatacgcgcatcagtacgcttcggcatcttcgcaatcgcctgcaatgtctgtgcaaacgtcaccgtcgtatcattgccgccgctcgaccccgtattcgccgcgcccgccaagtcccgcaaatggaactgtttgcgcaatacctccgcacaatcgcgcgcattggcttcaaaatatgggacgaaacccttacttttcgtcagttctttgaccgaagcatcattctggttctcgtaaagcaccagaccctgtttttccgcgtcgatccattcctgccaacgttgcccgaggaaccggcaccgatcctcaatagccgcgccataccagtcactcgcatcaccgtcagcttcagcaccgtacagcaactgtgcatacatctccgcgatgatggttgacttcagctctcctgtttcgtgagcatgtttcagccgattggtgaactcggtatagaaccgactatttagccccagcgcttgattccacgtgaccgtggtgccgaacacacagtattccagcggccgaacggtcagttgttcctcagttcccgcacacacaaggtcctcgggaagaatggtttcgttttcctgttccgctgccttttgcgcgtcttctttcacgtcttcgatgctcttagtggtgaacgccaccaagcagtcctccagagtcggatgccggccggagacgatgatcgccggaccatccttatacgactttcccagcacgccattgaccgccgtggggccgagagccaagaagaacagaccatccagcaactgcgcttcggtcagcatgattttggggcaatacatatatgcggtgcgcacaatacccgcaaaatgcgttgcgatgtctgtgtagtcgttgagcaaccgctcgcaggggcgatacgtatcggtcctgcaccacagattacgaatcgatggatacgcagggtactgcttcacaaggtcattccactcttggctctgctcagtggaatcgaagttcgtgatcatcgttgcccgtagcgattgcctcttgcccatacgcctagtctaggcacatcattggcgcacaggcacattaccatctcgtgcagttgctagacgagcaattagacaccggggtaaaaatcatcagatatcgatgccaatgcatcaatgtcatattctctcatggttgatgaatattcctctcccagagggaattgcttcgaaatatcaacagggcttaacccactttttcgcatcaacgcacgtttaaccaaataagcgaaacgtgggcattctgcacgggtcaatcggtcggcaaaatcgggaactccgtcgggacattttttagaccaatactgcaactcacaagtaacagcttggtccaacagtactgccgacgactcagccaaatcacagaaaaaatcatcggcagtacatacggagtaaggaaggccatctaactggctctcgtcaagcgatgcatacagctttcgatcattcgtcagcaacaccgaacaatcattatctactgcggcagcatgaagatgcaagtcgtttggatccgcgcccatgtaatcagcttgtgcccgctcacaatcatagtgatccacgacatgaaccagttcacgtatttgattaacgagaccgtttacctcatcgccggaacgtttcggattgcttcgccgatagtgataaacgacttcagcgaatacgtcttcactggagaagagatcgaacatctgaatcttgctggtcgacagagcgaaaagccaatctcgaatagtgcgagaatacagaatgttcgcatccacaaaaacgcgttccatcccgacatcccttcgttgctgacttgttcagccacgaatataccactcagacttaatcttccaactcgtccagagaaccacgcacggcaaggaaatgctccctcttaatttcctgttgcttgtctctgtattcaagaacatcgttgagcaggaaacgatgatgagcgcccaccttatgagagggcagctccccttcacgaaccaatttcaacaaagtgggtcgagaaattccaagcatttccgccgcagctgtggtccgcaattcctttggtgtggttgaaatgaccacacgagagcccttgctcagactctccaacacggtcgtcacaatgacagaaacatctttaggtaaatctacattgcgtccatcaacattcaacgcgatatttgcacggatatcttttatatcgtctacagtttgttcgatatcacgctgactctcggagtccaccagaatagtaagctcacgatcacgagacaaaacttccataagtacactcctttctctctttgcactcaataagcgtgaagacaaaccagtcaggctcggcgcgctttacacttacaactgaaagttacacttgtaagtgtaaagcgcgccgaggacatttgcgcggtatttacaggaatacgcctacggctaaaagaggtaaagaattaccgtgcagccatcaaatacaaatatattctgctaccgcactcatgcaagcctcaggttacgatgagtggctatgagcaattccgcacaggcctccgattcagccaacgaagcagccaacaacccagccaacggaccatcgtttatgccgcagcacattctggtaaccggtggcgcagggttcatcggcgcaaacttcgtgcactgggtggcgcgcaaccatccgcaggcccacatgactgttctggatgcgctcacgtatgccggcaaacgcgagaatctcgatggcgtgccggccgcgaacctgacctttgtgcatggcaatatttgcgatgccgagcttgtggaatccctgttttctgggctgaaccaacgctctgcagccgcagtacccccgattgacgccattgtgcacttcgccgccgaatcgcataacgataattcgattctcgacgcctccccattcctcaatacgaacgtgaccggcacgtacgtgttgctcgaggccgcccgccgccacgatattcgattccaccacatcagcaccgacgaagtgtatggcgatctggctctggacgaaccacgcaagttcactgaagacagcccgtacaagccgtcgagcccgtattccgcttcgaaggcggcaagcgatcatctgataagggcatggcaccgaacctacggtgtcaaggcgacaattagtaattgcagcaacaactacgggccgtaccaacatgtggagaagttcattccccgacagattacgaatattctcgcaggtatccgtccgaaactatacggtactggttcggcggtccgtgactggatcagcgtggaggaccattgcactgcggtatgggcgattcttacgcacggacgaatcggcgatacgtatctggtgggggcgaacggagagatgagcaacatcgatgtgctgcgcatgattctggaatgcatgggacagccgtcagacgcgttcgaccatgtgaacgatcggccgggcggcgataaacgctatgcgatcgatgcaacgaaaatcacgcgtgagcttggttggcgtccccgattcaccgatttcgccgaaggacttgacgagacaatccaatggtaccgggaacatgaggactggtggcgtccggataaggacgccactgaagccaaataccgtctccaaggccactgagcgaggccccaaccggaagagttgtggagcgttcgccgtgtattcgcatgcggcaaaggccaaaagcgaatacacggcacgcgactcagtccctgcggaacaggtcccttgtgtagaccttgcccgccacgtccgtgaggtcatcgttccaacggttggagatgatcacgtccgcttcgcgtttgaacgagtccaagtcgtgcgtgaccttgctgccgaagaaatcgggggcgtcgagcgtcggctcatagacgacgacctcgatgccgcgcgacttgatgcgcttcatcacgccttggatggcggactgacggaaattatcggaaccgctcttcatcgtcagacggtatactcccaccacaggtttggcgatgccgttcgccttggcccggtcgacgagctcctcgatttcgtaggcgatgaagtccttacgtgtgcggttcgactccacgatcgcctcgatgaggttctgcggcaccttatcgtaattggcgagcagctgcttcgtgtccttcgggaggcagtagccgccatagccgaagcttgggttgttgtaatcgtcgcggatacgcggatccatgcacacgcccttgatgatttcgtgcgtgttgagaccgcggctttccgcatacgtgtccaactcgttgaaataggcgacgcgcaacgcgagataggtattggcgaacagcttgatcgcctccgcctcagtggtaccgaccaccagctgggggatgcccctcgacccatccgggttgacgcggtccttctcctccggggcggcaccgtgggcgagcaggtccacgaacgtgtgcgccgcctgcacggcctccgcatcatcctgcggcgcgccgaccacgatgcggctcggatgcagattgtcgtacagggcgtggccctcacgcaggaattccggagagaacaggatacggtcgtcgtggaaccgttcgcgaatctgctgggtgtaaccaaccggaatcgtcgacttgatgacaatccatgcggtttggtcgtacttgcggatcgcctcgatcgccgcctccacgctggacgtgtcgaagtagttcttctgggcgtcgtaattcgtcggcgtggctatcactgcgtaatccgctcccgtatacgcctgttccgggtcgagcgtcgcctgaaagtccaacggccgctcgccggaccggtccgcatcgaggaatgcggtgatcttgctatccacgatggggctcttgccgttgttgagcagctcgaccttctcaggcacgatgtccaacgcgtgcacctcattatgttgcgacagcagcaacgccaccgacaatccgacgtaaccagtaccggcaaccgcaatcttcacgggacactccttctacgatgcgctacacgcaattctaactacgattagtgcgatgcgcagtcgcctgctactccttgccgacgcccaagaggaacggactggccggcagattcaccgagttgtacagcatgctggagctgttcggcgcaagaccccacaggtaacacacttgcgagatctttgtcacctcatcggaatgaacgattaccgtattgccctgtatagaagcgtcagcagtataaaacacgccgtcctggccggcgacctcgaagccttgaagtgggttggaagcactcttgacgagattcgttgccgtcgccttcgtgatgtaattcggggtcattgcgcgcagtccttttgctgtgccttccgcgaatgtcacagtaccggtggaagcgtcttcctccatcgccgatgcccgtcgcgccaacggtccggacggcaccgtcgattcactcgattcccttgaatcggtcatcgccaaccattgtgtcgccatacgcgcggcgagaatgtctttgccaagcggatggatgaccttcgacgtacctttgtccgtgtcgatcgaaacagtcatcgccagatgctccgtcgtgttcactgccgcactgtccagcacgtcgagctgcgcctgccgaacgatgggcgcgtatagggttcccactcgagtatcgtgcgagctgtacgcataggaacggcaaatcatcttctccgaataccgcacggtactggttgatgagcacggcgaaattacttttcatagcgcagcgccgtagcttgggtggcagtatcgtcttcgccttggtgccacaacacgccggcgacacgatatccggtcagcggtatgacgtggttggcgtagatactgccacctttcatatgcagtgcgatgccggtgccaccccatgaaatctggatgataccgacaggcacattcggatgtttcgcccgcagttgcgcggcgaacagttgcggcaggtaaccgagatattgcgcgtcggagccggtcgcgggtgcccatttggtcgcgctcaccgacctaagcggcagcgtgacgctcagtccgttggcggatgatttgttggagccgctggcttcggccgtgccggatgcggcgcatcccacaagcatggtcataccgacgagcaacatgatggcggcgcacgttcttcgcgccactgcgagcgctctcatacgaaccatcacgtgggggcaacgcacggatagcatcacctgacaagctgattcttccgttcatgatccaatcactcattcgtctgccgatttgtatactgactggtatggtacaggcacaaacttcaggttcggccacgacgttcggcgcggcctccacagcccagcaaaacacgtcggaaacgccggatgacgcatgctgggaaacggtgaacagggtcgtttatcctttgcatgatgccgatcagacgatgccgttgtacgcggtgaactggcatcccgcgtatttcgatccgagcgtgttcgacgagcgcgagaatctgtacagtgcgaatccgaacggcatgacgcgttccgagctcgcgcggctcatcgcacaggggcggcgtacggcgagcgaggagccgcacggcttcgccgtcgattcgcgcaatacggtcacattagcggcgggcacgcacctgtcgtgctgcacgtacttcaacgcgttcccagccggatactggcggtattggacgcgggtgagtaacgtgcggttctccgcgtggatgtcgggcaagggcacggtgaccgtgttccgttccacggcacgcggcctggcggcaccggtgcagtcgttctccatcgacacaaaacatggcgacggaggcacgcagcgcgtcgaggcgttgctttcgttgaaaggcatgctggacggcggcttctactggttcgacgctcgtgcggacgaggatgcgtcactgaccgtgggcggcgcggtctggcaagtgccggcctgtgaccgtcgcacgccgcagccgggtacggtgtccgtggcgattaccacgttcaaccgtccgtcgtattgtctggaccagttgcgcgcgattgccggagagccggagctgcgagtccggctggataccgtgtactgcacggatcagggcacagatctggtatgcaatcaggatggtttcgccgcggccgccgacgatctgggcggtcagctcacgtatctccagcaggcgaatctgggcggttccggcgggttctcgcgcggcatgttcgagacagtgaaagcgggacgcagcgactatacgctactgctcgacgatgatgcgatcagcgaaccggagtcaattctgcgcgcagtacagttcgcggactatgcggcacgccccgtgctggtgggcggcggcatgttccatatcgaccacaggacggtgctgcacgtgcagggcgaacgattcgacccacgttcgatgtggatgtacccgtcgcgaggcgcggagttcaaccatgattttcgctcggaaccgttgtcggacagcccggccctacacagcgtgaagttctccgatttcaacggctggtggttctgtctgattcccacggagacgatgcgcgccatcggtttgggtctgcctgcgttcatcaagttcgacgacatcgaatacggtgtacgcgcgaaaaagcatgggttcccgacggtgagtctgcccggcgtggccgtctggcatatggggtggcacgacaaggatccggcgcgtagctgggaggaatacttccaagtgcgcaatcggtgggtgtgcgcgttgctgcactatccaaatgccggcaaagcaagcgtgtttcgcatgctgtatgaggaagcgaatctgggactgcgcatgttgtattcgggcatggcgttgagccagatggccctcgccgatgttctgaaaggtccggcgtatttcgtggattcgctgccgtcgaagctgggcgaggtacgcaaggcgcgttccggtttcgcggacagtaccacgttcaccagcccgttggatttacctgagcctggcgatcatgccgaacgcgactgggcgccacagagcgcacgcgatgtgacaaagcaaggtatgaaggctgtgttcgctgcgctgcgatcccgcgtggacggttccaaggacgaggccccacaggtggcggttccggcacggttctccatctggccatcattcatcggcgtgcgttccgccttggtcacttcagccgatggggattcggtggcatggttccgtcgcgatagcaagctctaccgccgcaacatgcgcgtgtgcttcggccttgcatgcaaacttgctcgtaactggaaacgcctgtcacgcgaataccacgaatacggcgtcgcttccatggacacgtgggagcacatcttcaaagaagcagagtagccggaacgataacacggtgagaataggaatgcccgttgtctttggccacatcggagaccaaagacaacgggcattgccatgtcaaccggtcagttcactctggttcaggcttcaggccgctgcgggaaatcgaccttcggattgaacgtgatggccttgagcagctgaccgtagatcttgcgacgcaacggcttcgcgacgcggccgcggcgcatggcgttgtgcaccacgagacagaagtagaggtactgccacacattcctgtgatgcagacgataggagccttcgttgcgggcgccgtaggagaacttccacacgttcctgtcgtttaccatggaatagttgacgccttggttcatgcccatgtcgtgcagcacaatgctgtcagtcacttccacgccggggcacgactgtgtgatgcgcagcgtgtattcggcgtcgtcgaaccagatgaagtactccttgtacggcaggccgaacgcctccatcacccaacgcgggatgagtacagacacgaacgagcaggaggtgaccatgaccagattgtcgtagcccatggcctgcagacgtccccaatcccaagtagggatagggttgttcatttcggagatggacccgtcgatgaacttgaccatggagcacacgtacggtacatcggtgccaagtccggcgaccgcattgtcatagccttcgagcagcttcgccagagcggcgggctgcgggtagccgtcatcgtcgaagatccacacgaagtcggctccgagttcgtagcctttgcgcataccggcggagaaaccgcctgcaccacccgcattctccgtcagcgtaacgatggtgatacggaccttgtccttcaacgtgaagtcgcgttcgtattcggcaagatatgcagcggtatcgtccgtggaggcgttgttgacgatgacgagatgctcaggcagtcgcgtctgtgcttccagtgatgcgaggacgttcttgagtttttcaagacggttgtaggtgacgacgattgcggcgaccgtagaggtatttgcggatggcatggctatttgttccattcgttgagaagctggcagaacagactgttggcggtttgtttgtgtgagaaggtttcaaggcggttcttctcgacctcccacagtttgtggcggtccatctcattgccgttgagatgcatgagcgcacgtttcgcgtcatggatgaacgaggaggtcattcggcgcagcagtccctgcgacggcacgagggtttcctgagatccgacgttcgcggagagcacggggatgccagcactaatggcttcgattgtggtgagcgtgatgccctcgttcacggaggatacgagcagcacgtcggcatcggcgtaggtacgcgataccggaatgctcatgggacggcgttcgatgacatcatcaaggccatagcgtttgatgagcccatcggtgaagctgtccatatcaccactgccgtgcatgatgaaatggtattggccgggcgcggcctgcttcattgccttggcgacgagaatgaacgcgtcggggcgcttctggcgggacatacggccgacgaacgccacgttgaacaccctcgggtcgcggcgttccgcatagctcacgtgttcggagtcggcggtgagtccgacgagaggcgcgtcgacgactttggaggcggggatgtggtggatgtcttccatccagcgctccagctgcggggagatcacgtgatgcaggtcgatccactcgtcgtgcgcgagcgattcacgcgggaagccgccttggaacatgtattccacgatgtgcagcgaatccacgatcttgacgtccgggaagtacttcttcacccaccaggcattgtcgtacatccactggcagtggtgaatcatgatgccgcggatgtcgaactgttcgaacagggcgcgaagaatcgggacgtcaccgacgcggtactgcaacggctgagtcaggggaatcacgagcgcgccatcgcagatgggatcagtgatccatggttggtgaccgtcggagtcggtaaggacgatgggcaggaagcctgcttctttggcgagctgaatggtttccatgccccagcgttccgcacctccggcttggagccagtgcatggcgacgataacggccttgggcgcgtcgagaattcgagtacccggcttaatctcaacccatggatgatggttagcttcgctggcattcgccgcttcaatggtgagcggctcatacagtcgcacattattccgagccttccgctctcgttccgctcgttgcagttcacggatacggtcaaaggcgacgggccagcgatattcaagttcgttatacagtttaacggcacgactcgcgttgggcgcatgttcccagatgtcttcatctgtagcatcatccggcgtgagcaggatataacgatcattgcgatcgacgagctgctcatccccagcaaagtagtgaggagagaataccgactgcgcgttcacggtagaagtggcatcgaactctccaatgggctcgcgcccatcatccgacgtacatgaacctccgagggtggacgtatccgtcagacggggatactgccatttctcacccatgtaaatccggtagtgtaaggtccggccgggttgaatgagtgagtggtagttgaccgccgccacaacaagtttgcgttgacggttgctcagcgagtccaaaaactcacatgcgtcttgatctagttgagagaatcggcacatgagtttcattgtacgcacgcggggcgaagtacgaccatctactaccggcacacggccgacgagctcgacctgccggacgagctgtgggaactggtgcgcgtcaaggccaacctgctcaccccatccaagaaacccatcgctcgcgacagtgaacccggccaagcccgtccgccgcatccacgatatccagaaccggctcgagaccatggccgcgccacgcaccgcaaggctggccagacgtacgggcccggacatggcatacttgaacaagacgctcgcagggatcgcgggtgtcgaaccggaatacaacgaaacccccacaagccgacaaggaataggattacacgctcactttccgatgaggcactccgaccgtgcagcttaagtggaacttactgcacagattcatcttgcttcatattgctgacatagccatcaaaacgattagcaaacaaatccggagaatccgaataccatctattgaaataatctttcaaagtcataatatcttcggcttcaataggggacactctctcataaacatgaactacgacagggccgtcaaactgaaacgatcgacgttcaacataatgacgcccaagaaaactagaggaatcctgcaccagactattgagtgcaacaacaactctttcgttctcttcattcatgtgcaaggaaactggagtagatgtaacaacaaaacgagcatcaaagaattcagtattaaaaccatcacgcgaatcgacatcagctgcaataacaggaaaagctgatcctactacatccggaagcaaagtcgtatcggcaagagaatagtttaagttagcactcgcagcagcaaaatataccgcttctccattcacggtctgctgacgaaggtatgtaatcaactcacgtttctgcgtaacatcattttgcttgataggacgaactacactttgcttacccagcagaagactaatctgagaaggaacagacacaacagaaaacccttgcaacaaggaaacgactgatagagcaactactattagattaatgacagtgcgcacatcaccattcttcaacagatttacgcatgaaaagaatggaaccgaagaaaaaatttcaataaaaaagagaataacataccaatgctgttctccaaagtcctgaacatgccagaataccacagaggacaacacagcacccagaaagacagacacgggtaaaataatagactcacagaaatctgttttattcaaaaccgatagacgagaatatacgatacacaatattacgacactaattaaaccaacaataaaccaaagcaatccgattctgttgacgacattaagaatcttggcgggataagaatcatagacagtccaagcactataggattgcgagtactgacctccggcggatctaaacacaaaaggccgaaagacggacataagaggaagcgcgacgacaatagccaacgtggccacacggaagcataacaatttaaagagcgcgatgcgaccggcacttgcatttacaacaatcgcacctgtccaatatatcaaacagcataaaaccatcccaataacaccgaagataaaccaccttctaagcaaaaacacaccgcataggcctaagccaataaaaatagccccaaaacgtctctttgggaagtttacatccatcaatgcaacaagtaaagcaataaatagaactgcgggtacggcatcaaaatagcctaaaaatataggcgcaagaaacgagggagtaaacaaagagaaagcatacgcggcaacaaaaactccagacgaaccattagacacactcgaacccattgatttggatacgatgaaccctgccataagcaatgcggctggaacggcagcaatacatgactcaataaacacagcccccttccatgacgggaaaagatatactgggaaagacataatccacgacaacagcaaattataatccgagtaattcacactgtagacaacttgccgaaaagtatccacagctccattctgcagactgcgattaaagcctaatgtattgttccaataattggcgtaatcccatatgggaataaagttatattgagacaagtagatgccagcaaatacaagaaagacaaaagtaaggacaatcagagaaattgccgcacggaactgtaattcaacgacaactttcaacgcctgagtattacgcactattaaatatacaataaagtaaaatccagcaatgccgatcatactcaatgcaataaatcgtccttcatgaaaggacatcatagagacggcaacgccaactagtgtcaacactgctaaaaaagctcgattattgatagccagtttgcctgcaatcatcttcatttctttaccttcgcatatctattatatttcacttacactcgcgaaagaagcaccttttctacggggtgcacaattattgcatcaattagccaagaaatgcaacttagaacaataaacacaataacgataatacacactcccgccatagggcgtagaataggcagagagggagggtaactcattttcgagacgcaatcccatacaatgcgaaatccgaaccagttctcgtggatgaggtagatgccgaaagtggtaggcgctatggtacagatagctctctgcacaacctccggggattggttcatatcgacacggcttaccatgatgaacaccaacataccgatgatgatggggaagagaacaatgccatcatgaatccggtttttccaccccatgaaatccaccagccatgattgttccgatatgtaatggttgaacgcgaccatgagcaacgtcaacgctacgattattccaatcattgggagagttctgaacctatcctcataatcttgataatacttgcgcaaccatccgcctatcagatatcctaacatagcatagacgagattgttccagttcgaagcacgttcgaagatgagaatctgaatactgaagaaacccagtagcacaatcaacatctccatggaacgctttggcaacgtattaaacagtgtattgagatatggtgcgactaaaagcatcagcaggtacgcaccaatgaaccagtaactgttgtagaagaacgggaataaactggccagtatcgaccgatacaaatccaccccatgcattatcggctccaccgccataggataatgatggaatgcacccagtaagagcacgataatgagaaaggccacggaatagcagaacatctgcaaccaagtctttaccaaacgattccacttgaacgacttctccaccaggaagtacccggagatgatgaagaagatggatacacccacctggccgtactgcacaatcacgaatcgcaatgccgaccaccagccaggctcttgtggaagaaccactcgcagctgatgatggtcccagtcgaaatgaataacgaaatggcacgtcagaatcaggaacatcgcgacaatgcgcaacagttcgatggacacgttccttgcggcaggtttttggggcatactagttccttccctcgcccgcatagtcgatcatggcgatagatcgtccatacgtcgtctccagtaaatccgtacctaatatagggggaaccttcgaagtgctgaccggctgcaggggtatactgtccgcatattctgtcctttcgaagaagcggagccggcgtggaagcagtatcatcacccccccttgtttcggtcatcatccccgcgtataacgcgcaggagtatgtcgccgagtgcgtgacgagcgtcatcaagcagactgcgaaggacatcgaggtcatcgtcgtcgatgacggttcgaccgacgatacccgcgaaatcgtggcgtccatcgccgaacgggatgctcgcgtcacgttgctcacgcagtccaaccagtacgccggcgtcgcccgcaacaacggcatggaccacgccactgggaaatacctgtatttcctcgatgccgacgacttcatcgaaccggacacgctggaaacgatgaccggcatcgcggaacgcaccggcgtggatatcgtcgtcgcccggtcgaacagccatgatgccgagacccatgaggaagcgctcatcgactacaccatcaaggacatgtcgacgagacaggtgctgcataacgcggattacgcgggcaccacgttccagagcttcatcggatggccgtgggataagctgttccgcgccgatttcatccgcgagcgcggcttacgcttccaggcgctgcgcacgacgaacgacgcgttcttcacgttcgtggcgctggccatcgccccgtccatctactgcacggacgcgatgctgttccaccaccgcacgcacaacgccacatcgctggaggcgacgcgcaggaagagctggcagaacgcgctcaacgccgtcacgacaatcggcgactatctgaaaactacggataactacacgctcaccaagcgtagctacgagaactgggtatcccacttcatcttgtggaacgtgcagtcgctggaacgtccgacggcggtcacaatgatggacgcctcctacccgctgctggaggcactgccagacgacaaggactactactacgaggaacgcgactatcgtttcgtcgaactcgtgcgacagacccgctcccagctgattctcaccgcgttggacggtgattggcatgtcggcgacctgtggaagcaattgtgcgaaacccgtgattgggtggaggtgttggagaaacgcatcaccaaccgcgaccacactatcgaggcccagaaccgccagattcatgatcttgaccggcgcgtgcgcagcatctaccattcggtctcgtatcgactaggtaacgcggcgatcaaaccgctttccatcgcgaaggatttgctcggcaggaagaagtagcggcgcaagccccccacatacccgcctcccactagaatatgtgagaacgctgggcagagacactggcggcagacgccatgttgtctcgcatgagtaggataggacgcttgtgaaagacgtgatcaaacgcctccaggagaggtaccactatgcgctggtcgtattcaaggagctggtgaagaccaacttcaagctgcgctaccaaggctcgtatcttggtgtgctgtggtcggtgctccagccactgatgctgttcgccgtcatgtacgtcgtgttcgtcaagttcctcaagttcacggacggcacgcccaccttcccgatttcgttgctgtgcggcacctgtctgtggcagttcttcaccgaatccacaagcatgggcatgcgttccatcgtggaccgcggcgacctgctgcgcaagattcacttcccgaactacatcatcgtggctgccaccacgatggggtcgatgatctccctagccatcaacctcggcgtggtcatcctcttcggcttcttcgcgcacgcgcactacacgtggcgcgtgatcaccgtgatccccagcatcctgcagctgtacgcaatctcgctcggcgtggccctgctgctcggctcgctgtacgtgtacttccgcgacatcgaccacatctgggatgtcatcctgcaggcgctgttctacgcgacccctatcatctacccgctgtcgatggtgcagaagaacccggagttcagctgggccgccgacttcatgatgctcatgccgaccacgcagacgatcatggacatccgccacaatctgctgtcgccggaatacgtgccgaccatctggaccgtggtggacaacaagatcctgtgcctgatcccctacgtgctgtccgtgctggtgctgtggctgggcgtccacgtcttccgtaagtacagcgccaagttcgcggaggtgctctgatggccgacaataccatcgacaacacgaccaacccgactaacccgaacgacgaccgtcccgtcgtcctcaaggtcgaccatgtggcgaaatacttccgcctgcccaccgaacaggccacgggcttgaagatggcgttcctcaactggacgaagggcatcaagggattcaccgagcagcatgtgctcaaggacatcagcttcgaggtgcgtcagggcgacttcttcggcatcgtcggacgcaacggttccggcaagtccacgctgttgaagatcatctcgcaaatctacgtgcccgaaaagggcagcgtgtccgtcaagggcaaactggtgccgttcatcgaattgggcgtgggcttcaatccggagctcaccggccgcgagaacgtgtacctgaacggcgcgctgctcggcttcacccgcgaggagatcgacgcgatgtacgacgacatcgtcgagttcgcggaacttgaggacttcatggaccagaagctcaagaactattcctccggcatgcaagtgcgtctcgccttctccgtcgccatcaaggcgcaaggcgacatcctcgtgctcgacgaggtgctcgccgtgggcgacgaggcgttccagcgcaagtgcgacaacttcttcgcgcagatgaagaaggacccgaccaagacgatcatcttggtcacgcattcgatggacgcggtgaagcgctactgcgacaaggccatcctcatcaaggacggcgagattgtcgtctccggcaacaaggatgatgtggccgaccagtacacgctcgagaacctcaaggtccaggaggccgaacagaaggctcatgccgcagccgtgaacgctggcaccgaatacccggccggcctgagcgaacgcgtgcccgtgctgaacgtgcgcgcagaggactcccagctggtgaaaactgcagatccgttccggttccttgtggattacgagttcaatgaggatgtggaattctacctgacgctcaccctgctggacatgaagcgcggcggcatcatctacgatacggccgccgacctgcatcagacgaagcgcggacgccagaccgtgacgttcgagctgccgctcgacgcgatctgcaatggcgattatcgcctcaccgcgcagcttcgttccttgcctgacccgagcaacatcaagtcgaaccagcagcttgcctacacggacgaaagccgctcctgcgacttcgccgtgcgtatccccggcaacgagggctacggcctgctgaataaaagctcgatgcaggtgaagcagctggactgattcaggcgagttttttcgggggtgtcggcatcatatgatgcgtcgtgtgacgccgtcatccccaccaccaaatacgttaattacaaacatcagagaggatgtgtctccatgcattggagcaaaggaaagaaattgctagtacgatccctgtgtgttcttactgctagtagtctgatggctgcccccgcttatgctgcttctgccacgtcaatcacccgactggacggaaacacgcgctatgagacgatggggcgcgtagtacaaacagcgttcccgaaacaatccgactatgccgtactagcttcaggagacaacttccccgatgctctggctgcttcctcacttgcaggtgcattaaaagcacccatcattctgacaagctccacgactctttcaagcgaagcaaggaatgagcttcaacggctagaagcccgaaccgtagcaattgtcggaggctcatccgccgtatcgactgccgtcgagaatcaggtgtcccaaattgtttcagacggaacggttgttcgattctcaggagagactcgtatcgaaacagcattgtccatctatcgcaacgcgcctagacaactccccgtaacatggtcccgaacaggcatcgtgaccacatcatccaattttgccgatgcattgtcgatttctccatatgcctattccacagcttctccgatattcttaacagacaagaatggattggaaccagatgtacaacaatcactctctcatttcgacttcgataaagcaataatcgttggcggttctgcagtggtgcccaatatcgtagagatccaactgtcaaatcagcaactttcaacaacaagattgtctggcaatacccgctatgataccagcaaccaagtcggacgttttatactaaatgaatctgtatacactccgagcaacatagtatttaccaccggagagaatttcccagatgccttggcgggaagcgctcttgctggcacccgaaacactattctattactagcaggcaataaatattctcccaccataccgttcgccgaacaaaatatttcttatcctcgaaacatttatgttttaggcggtaaaaatgctttcacctcaccaactatcaactttatttctctgcgctatggccacggagagatagaaccagatccaagtgaatatgtgaatgaaagcggagtcacgcctggcgcgtggtgcaaaaagagagatcgcggaaagaaagcactcagcaaacatggaaccgtgatgatctgctcggcagatccagaagatcccgacacatatcgttggcgtgagtatactggctggtaaagttaaaggacatgcctcgaagttcgactcacactggtactgttttatcccaagtttctgctggtagcactctggcgttcgcgggcgtgtgatgaagcaaatccataatttcaatacgcgcccgattattcattgataaagttcatagaagctgatatactctttcaccacgcttaagaaagcattgagctgagtagacactatcccatatgcttatgagcatgagcatagatattcgcgcatggttctgggagtcaaagaacagggtacgtcggacgacaacgcaccttggacgacggattgccagcaaacaacgcatcatcgcctcgttgacatcatatccgccacgtatggccactattcatctggccatacgctccattcttgcgcaacgcacactacctgacaaagtcgttttatggctatatgaaggagacttcccaaatcgggaagcggatctccctgatacactcatgcatctcatcggacatgatgttgtaatccgatgggtttcagaaaacctgaaaccgcataagaagtactactgggcgctacaagaattctcaaaagatcttgtaatcacattcgacgatgacttggtatatcctaatacctatatttccgagcttatgaaggcacatcgggcgcatcccgaggcggtaatcgccgcgcgcacgcatctgatgatgttcaacgaagatggttctctaaaaccttacgaccagtggatttacgaagctcccgcgcgttatccctccatggtgaataaaccatcgatgcgtctgttcgccactagtggcgccggaaccctgttccccccgaatgtgatgcctccagagactttcgacatggctgcaattcgcgctacagcgttgaatgctgacgatgtttggctgaaggtcatgcaggtcattggccatgttccggtggttgccgctaccgcgaatcagattatcgccaatattcctcttgctgaggcacagacacggaatcgccttgcatacgttccagacacacaagaggaagcactctgccacgccaataccgaggcaggcggtaatgatgtcattcttgcggatacacttgcataccctactgtgcacaatgctcttaaagaagccttcccccttcttgtccgagatgatgcccttgacaaattcctcagatagtaactggctgcgggcaggggggcattccgtcgacgcccctgcccgtcaatcacatctttctgatcgcatcgtcatatgccttctgcgcatcatcaagttcggcattcgccttctccaaatttcggtcagcagactcacggttagcagtagcaatagcttccttttgcttggattggcgcaatgcatccgacgcctgctgcgaccttataccagcttgagtcgctttgtttttcgcatcgcgatatatggctccagcattcttcaaattagctatgtattgattgagttgcttttcgtattctgcaactgttaaatcaccgacaccagtattgtaattctggacacgctgactattgtcaccccacccttgcgcattaccgccccacgcaacggcaccaccaaaatcggtcgtatagggatcgacaatattgagatagtgtccaacctcgctgtacaaatcaaaattaggcctttcgctgtttggtgtgggtgggtctgtcaggtggtgacggtgctgaggtcagagcatccgactgttaatcggacggtcactggttcaagcccagtcgcaggagccatcgaaagcctcggttctccgaggcttttttattttcatcgcattggtgaccagacacgacaccccatcatcaaccgggaaatccatggcgaagacctcaccactactcacatcaggcagacaggtcactgtcaattcaccgatgagaggcgcggtattcccagtatcagtttgggaataccgcgcaaatcttacatcgagaccttggtcaggggcatggcggagtcgatcgggaagtcgggggcgctgggggccacgccggcctcgaccaggttcacgccgagcatggcgaccatggcaccgttgtcggtgcagagcttgatttgcgggatacggacgtcgacgccgtagttctcgccgaattcgagcagtttggcgcgcagctgcgagttggcggagaagccgccgcccacgatcagcgtgttggaatcgtactgccggcagccgcgcatggccttacgggccagcacggtggccacggaatcggccagggaggcgcacacgtcgtccaccggaatctcatggccggcggcctgctcgctttccacccagcgagccacggcggtcttgacaccggagaaactgaaatcatacgggtgcgcggcaccggccttgccttgtgtcaggcccatcggcaccttgatggcgtgcgggtcgccgttctgaccatggcggtcgatgtgcgggccgcccggatacgggaagccgagcaggcgggcgaccttgtcgaagcactcccccgccgcgtcatccagcgtggtgcccaccacatcgattttgcgcggcatgtcttccacgtgcagcagcgaggtgtggccgccggagacgatcagagccagcgtgtccttggggaacgggccgaactgcagctgagtgacggcgatgtgcccgatcacatggttgatgccgtaaatcggcttgttcgcagcccaggccagcgccttggcgccggacacgcccacggccaggcaaccggccagtccgggaccggcggacacggcgatggcgtccacatccgccaacgtcatgttcgcgtcggcgagcgccttggacacgcatggcacgaaggcctcagcgtgcgcacgggaggcgatttcggggatcactccgccgtatcgcgcgtgttcctccatggatgaggccacgacgttggagagcagttcgcggccgcgtacgatggcggctgcggtttcgtcgcaggtggattcaatacccagtacaaccggttcgctcatcgtgcttctccgttcttctccgtttgcttgctggtgatgtcttcaatgtccgccgatgccgtctgcggggcggcaaagcccacgaccctaggtttcaggtccaagctcatggtgtatgcgtcgatgccttcgggctggtagtagcgtttgcgcaatcccatgcgttcgaatccgaaccgctgatatagggccagcgcagggtcgttatccacacgcacttcgagcagcatgcgcgaggcgccctgacgtttcgcctcgtcgaccagtgcctgaagcaacgcagcggcgatgccttgccgctggtatgccttgcccacgccgatggtcatgagctcggcgtcctcgccgtcgtaccagaagccggcgtagccgcggacaacagcctgttccgcctctcccagcacatccagcagatacgtgcgggcgggcgcgtccagttcctctcgcaccatgttcgcattccatgcgccgcggccgaacagttcgccttccaactgtgcgatggaacgaaccgcaagatcacgacttacggcagtgatgtcaacaatcatcggaccacaacccacttcacgccttatcggcaccggcatggccgagcacgtgcttcagtgggttcggtacttcggcgtccggccggcgcaggtacaacggttcgatcggcacgacctggtcgccgcgcagttcgcggctcaacgcggtggtcgcaaagacggcgagcccggctttcccggcatccaataccgatccgtccaccacggagcccagcgcacgcagtccctgccagacggatgcgtatttggccgcgccgtggccggtcacatccaccacatagctgacgccgtcgcgttcgccgtgttccgcgagcgccgcgttcacccgttcgacgatatgctccgggtagtcgatatccatctcgatccagcgtcgttcggcggcgtcctcgtccggcaggctgatgctgccgtggttgagcgagaagtacagctgcttgcggcgcgcatcgttgacgcacagcgtgacgtggcggtcgagttcgtgttccttggcctcggcgtccgggacgtcaccatccgattggcgcgaactcaagcgcggcacgtcggccaggaaatcgatgccgtcgaacatggcgctgtcacccagcacgaagttcatcatctcgccttgcgggtcgagtacgttctgtccgacgagcttggccccggtggcgaaggccaacgccttggcggccacgatgccggcgcgcaggccggtgaatggcgccgggccgatgcccacgacgatctcctcgatatcggcaggagtcaggccggcctcctcgaccgcgcgcgcgatattgacctgcagtttctccacatgggtgcgcgaatcggtctctacaatgggctcgcgccccacaatgccgaccgtcgagccgaatgaggtgtcaatcaccaacgtgcaacccatgaatcctcctagtcgtaaagcctctagagagtgtacatcgaggagtctatgggcgcatggcttattgcaggtcgaacgcggcccatcgcttgccgactgggacgaatgcgacggtacgagtgccgttgctggtgagttcgccgtctgatccagcggatgcgatatcggaggaatcgagaggtcgatcgatatggatttcaagtcgttctggtgccaaggcggtggccatttgttcgccccactccataagcaccaccgtgttctcgccggggtcttcaagttcttcgtccaatcccagcgattccagctcgtccaacaaacgcccgatggcgtcctgccccggcgcataggctgagccgcccagacggtaggcatccacatgcaccagatgagccggagtgccgtcggcgaaatgcccgtcaagttcgcgggcaatggtgaatgtaggagacacgatgggttcggtaatgtccagccccgcgccgaagccttgggcgaatgtggttttgccggcaccaagagggcctgagagcagcaatacatcgccgccgtgtaccattccggccacgcggcggccgagctcctgcatggcctcgctggtgggagccgcaatagtgtgttcgctcataaatacccctttatcgacttttaccgacctttatgactgatgtcttcaatgcagcgttccagcgcatataccgggtcgccgccgttcgttttgctttgctcatccgcccaggcgagcatacggatgcaatgcgcgagtcctgccgaagtccagccgccaagttggcgcatcgcattcttcagcacccacggattggttttcgcttcggcctgtgaaatcgtgccggcccggaccgccgaggctttggcaatggtacggagcttcatggccaacgcgccgatcagcgcgatgggatcggtcccttgttccacagctgcacgcatcatgacgatggcttcggcggttttgccttccacggccttgtctgccacggcaaaaccggtgacctgcggattggcggtcaaatactggttgacacggtcgagccccatcggattatcgtcaaagtcgaaacacaattgctcgcacatggcggcgagttcgccggttttgccgccgagcacggataccagctgctgcgcggccatcggttcgactctacgaccgcgtttctcgaattctccgagtacgaaattgagttgggcatccggtttcttcaaatccggcacgtcctctttgcgagcgccggctttcaccagttggtcgatgatcttgcgccctttgacgccgccctcgtgctggcagatcaccacgctggagccgttcggatccttggcggcctgcttggtgtacgtcaccagagcttcggcgagcttttcgtcggcattctgcaggttgacgagtttgaccacggcaacgtcggaaagcaacgatgggctgacggcttcatcgaaggcatattggtcggccgatgtggcgtcgagctcgatgagttcggcgtcgggtcgcgccttcaacgcttgtgcgcacagtgccttggtgcgcgcgtcgttcaaatacgagtcgcctccgggcaccacggttaccggtacgttcgctgctgttttcgccatgcccccatctcgccacacaggttggacaatgacctgccggcataacggcccggcagcactccgcgattaggcgtatgcctcatccaacagggcgtcgatatccgcgaaacgcttgggagcgggacgccataccgggtgaccggccgcgatgaccagtgccgggtgttccaacgcgcgcaggtcgtccagcggattggcattcagcacaagcaaatcagcggatttgccgacttccaaagaaccggtctcggcatcgacgccgagaatggaggcgttgacggcagtggctgcgtgcagggcctcagccgggctgaaaccggcgtatgcgaccagcagctccagctcacgccatgtggcgtactgcggcacgaatgtcatgcctgtatcggtgccgacgcctatcatcaatccggcctcgtgcgcttgacgggcacctgaaaccatgcctccgaccacgtttttggaattctccaattggatgtcggtgatgccggtcgcgtcctgtccaagcaaggtcaggggaaggccggcggaaagtgtcggaaccagcgccgagtatccgcgcaacgcattcggattgtgccggaacatgccgatcaattcgtcgtcgagcacgctgccgtgttcgatggtatcgacgccggccagcagcgaacgccgcacgccttccgggctttgcgcgtgcgcgccgacaataacaccgtactgatgcgcctcatcgcaaatcgcccgcatctgttccacgctcatctgcgggctgccggcctcgccgatttcctgtgcatcggttacgccgccggtcgcggcgattttgatggcgttgacgccagccttgagattctgcgcgactgcggtacgcgcctcttccggggtgccgctggtcagtgcgataagcggggcgccatggccttcgggaatcgccatcagcggtccggatgccaagatacgcggtccgaggatttggcctgcatcaatctgatcgcgtaatgtcacgacttcatatcccacgtcgccaagcgtgcggatcgtcgtaacgccggattccagcaatgttgtggcgttgtgttttacggttgcggccatgtacggcttgcccaatggcgaatgcgcgaatgtggcgaccatacgttggcctttgggcgtcgccagcttcggattgagcggcttgccttgggagaacagatgggtatgcgcattgatcagccccggcatcacgattttgccggtgccgtcaagatagtggtattcggctgggatactggtttcgatgctgggtgcaacctgttcgatacgtccgtcggctccgaccacgatcgtcatgttacgcagtatggttccggctttatctccggtgacgatgatggcgtgggccaatgcgaatggttcgactatcggattatgagacaacatcatcgccggcactccttcatgcagctggttgaactggtctcaactgtatcgcagttttgccggctgatggtttatgccgcgcggcctatcgcataggttcggctggctattgcgatggttgctgcaccgaataccgcattggctattcggcttgccgccgcgtaaagagacgtctcgtctcctcgcaccagagactgaggcggacatgccaagcggaaccgaagcgcacgccaggcattccggcctcataacgacggacatgctggaggcaacggctgacgaacaccagtagcatgccgataccgatttccaccgccacaatcagcacggcacccgtaacgccgtctttccatgggatgacggccatcgtgctgccacccagccacaacgccacccgttccatcaccagcgtgccccatgacgatatccacgcgaatacgccggccagccatggctcgcaccatgcgcaggccaatgccatcaatcccgccatcgtggccaatcccacaaacggcgacaccaacaggttcgccggcacggacagcaacggcaactccggttccatcaacacctgaatcggcagggtgaacaactgcgcggccacggtcatcgccatcatttcggcgatgccgtgcggcatcgctcgctcaaaggcaccggccagccgctccgcaaacagcacgatacccagtacggcggccgaagacaaggcgaatccgtagctggccgacatatccggattcaccgccaatacaccgattaccgtccagcacagggcgctcaacgcttgcgtacgccgccccatcgcatacgtcaacgcacctatcaatcccatgatgaacgcgcgggtgaccgaatcactggggaacatcgccaatgccagcagcacatatactccagagaccagcaacgccgtcagccgccgatcaagcagcatccacatgcataaccggcgcaccaatcccgccaccagtacaaagtggccgccggatacggccatgaggtgcatgatgccggactggcggaactgattttccaacgtttgcgcatacgtgctgttgaccggcatcggaccggtctcgccgccgatataatcctggccaagcacacccatcgtcaatcccggcaccaacacacgcccctgatcggacaattgttcggtcacggtgaaaaacgcctcctgcacatgcgcaatcgcggcgagatgccacggcggagcccgcacctgtgctaccggctgttttccttccaagagcagccatagtggtatgcgtccatatcgcgcttgctgcaatacgcctgtcagcagatggaccgcgcctcgacgcaactgcccacaatacgattcgtcggcgtatacacgcacagcgaccgtggaacgtacatccgtaccatccacagtgatgccgctcagccgtatgtccgtctgacaatcgtatgtgcgttggtccgaagcgatcacgggcgtcgtcaccgtggccatgacttcgtggtatgaactggattggcgagcttgtgcggaggcaggatcatgccaggcaatggtgtccgacgcgattgccgtcatactgccgatgcacgccaccgcaacgcatacggtcaatgttcccgtccaccggatccgcaggcggaaagacaccacgatcatcgccgccacggcagcacatgacgccactgttataggcaatattcgtgtgacaggccattccatgccgattatggtgacgtcaatgccagctccggcatcggcctttgcctgaccggtgccgagtccatcagacatcctccatgcgaataatgcgtgcgctcccagactcgccgcccacatcactatggcgatcggcagcatcctccaatcgcggctcccctgctcgcgcagtatccaatccctgctcatccgaccgtcacctgccctcgcatggtctccaacgtcttggagccgatgcctttgacatccagcagctgattgactgatgtatacccgccaatcgccgtgcgatgatcaatgatccgctgagcggtaaccggcccaatacctttgatggattgcaattcctcagcggtagccgtgttgaggttgatgagaccatgcgtggaagcgccggcatcgctgccgtccgtctgcatgtgcggagattgcgtggtatccgattcggggttcgctgtggcatcggaatgctccgactgctgcggatccgtgcgtttctcgtccgtggtgttctgcgatggcatcgtctgatctccagcggagccgcccgtggtctgcatggcggtcggttgagacagcatggccatattcatcgactgttggaccagcaatgccaagctgatgccaagggcgacgatcagcagcaatatcacggccaaggcatgcccaatggtgaacgacaatcgcggctgatcccgggtgagtctggctgattcgccgacggcatcggcggaacgtacgccaatcagatccgataacgcacgtttgtcacgggtcgcctgccgcaggccgctctgcgccctttggggcgggtggccagccggacggatccgtgcatggccaggaggcggcggaggcgtcgtgggccgttccactcgcggttggggcatggctgcgctctgcctgctgaatgcgcgcaaacggttggcggcatggtctgcgcgatggttatgagaaacgcccatgcatccacgctgatggattcatgggcgtttgtccagctgaaacggggtatgtggttctagcttatgaagttatccacaattgaggtgggcggttgacgctcccctcagtctcgctacgcgagccagctcccctcaaagaggggagctggctcgcaacaagtcactccgcgggaacgatggagacgatcttcggggccttgacgatcaccttgcgcggctccttgccgccaagacggtcggcgacggcggccagcgcctgcttctcgagatcggccggatcgatgtcgaccggcacttcgagcttggcgcgcaccttgcccttgatctgcaccacggcggtcacggtgtcgtggcccacgtagcgttcgtcggccaccggccacggctcggcggacagggattcggcgtgaccgagcttgctccacatctcctcgcagatgtgcggggcaatcggcgcgagcatcaggatcagcggctccacggcggcacgcggcacagccttcagaccggtcaggtggttgttgagcacgatgagcttggcgatggcggtgttcgggcgcatgccttccatttccgcggtcacttcggcaatcgtgttgttgagcagcttcagggtcttttcgtccggcgtgtcctcagtcacatgggcctggccggtggtctcatcgaccacattgcgccacagacgctgcaggaagcgcatgccaccgaccacgttgcgggtgttccacgggcgagactcgtccagcgggcccatgctcatttcgtacaggcggaaggtgtcggcaccgtagttctcgtacatgtagtccggggtcacgatgttcttgagggacttgcccatcttgccgaactcgcggttggcatgttcgccgttccaggtgaaggtcggctcgccggaggcgtcggccgggccttccacgacctcgtcggccggcacgtactggccgcggtcgtcggtgtaggcgtaggcctggatcatgccctggttgaacagcttgtggaacggttcggccgagtccacgtagccgaggtcgaagagcaccttgtgccagaagcgggagtagagcaggtggagcacagcgtgttcgacgccgccgatgtacaggtccacaccgccttcatcacccgagtacttgttgtggttcgggcccatccagtagtcgaactcgtccttctccaccatgtgcttggtgtcggtcgggtcgatgtaacgcatgtagtaccagcaggagccggcccagttcggcatggtgttggtgtcgcggtagtaggtcttcttgccgtcgcccaagtcgagctcgaccttgacccagtcctcgttgcggctcaacggtgcctccgggttggactcggcgtccatcggatcgaaggtgcgcggctcatagtcgggcacgtcgggcaggttgatcggcaatgcggaatccggcagcaggtgcggggtgccgtcttcgccgtagacgatcgggaagggctcgccccagtagcgctggcgggagaacagccagtcgcgcagacggtagcttacggtgcccttgcccacgccggcggattcgagccaggcgttgaccttggcgatggcgtcgtccacgcgcaggccgttaaggctcagcgcgtcgcccttggcttcggtggcctcgacggaggagttgatcacgatgccgtcatgggagacgaacggcgccttgccctcgtagttggccaagtcgtcgccggaatccggcagaggcgtgacggtgtagatgacaggcagaccgaacttcacggcaaagtcgtaatcgcgctggtcgccaccaggcacggccataatggcaccggtgccgtagtccatcagcacgtagtcggcagtaaacagcgggagcttcgcgccggtgatcgggttggtggcgtacaggccggtgaacagaccggtcttctcaccggcctcgttcacgcggtccttggcggtcttggcttcggcggccagacggtaggccttcaccgcctcgaccgggttggcatagccgcccttccagtcttcgggtacatcggccggccattcggcgggcacgttctccagcaggtgatgttccggggaaaccacggcgaacgtggtgccgaacagcgtgtcgggacgggtggtgtagatttccatgtccttgtcaccgtcggcagtggccacgatgaagtgcacggaggcaccatgggattcaccgatccagttgcgctgcatgagcttgaccttctcaggccagttgatgccgtcaagatcggcgatgaggcggtggccgtacttggtgatgcgcatggaccactggcgtagctcacgctggaagaccgggaagttgccacgctcggacttaccttcggcggtgacctcttcgttggccagcacggtgcccagacccgggcaccagttgaccggggacttggagatgtaggccaggcggaagtcgttcaagatatcctgctgctcggcgtcagtgaggtcggaccactgcttgccatcggactcgtggcccggaatggccttttcgccggattcgaacttggccacgagctcggcgatcgggcgtgcggagcccttggagccggacgggttggtggcgtcctcgtcgtaccaggaatcgtagatgcgcgagaagatccattgggtccagcgcacgtagccggggtcgatggtggcgaacgtacgacggttgtcgaagctcaggcccatacggtgcagctggcggctcatgttggcgatgttcgcctcagtggtcacgcgcgggtgctggccggtctggactgcgtactgttcggcaggcaggccgaaggcgtcgtaacccatggcgtgcaggacgttctcgcccttcatgcggtggtagcggctcaccacgtcggaggccaggtagcccagcgggtggccgacgtgcaggcccttgccggacgggtagggaaacatgtccatggcgaagtaggcggtgcggccttcggcgttacggcccttgccgtccttcaaatcgccgttgacgttggcggcccagaaggtgccttgctcgtcccaaatcttctgccacttgttttcgatgtcctgcgccagtgcggcgttgtagcggaagttgggctcttcggtttgcgtgctcttctcgttgtcactcataaatcagcaaggtagcctcgcaactggacacgtcgtcaatcgttattcagcatccgagacgatggctttggggtcgccgttcagcgaaaccgtgagctttgtttggcttgtgaacgtatccttggcggccgtccagctgccatcctcaaccatgtcttccaatgcttccgcgattttctgcgccaattggctggtgccttgactcacggcgatgccataactgacctcgcccttgtccgcaatcacgtccatatactggggcccgttggccgcttgaagaccggaaagcaccgccatatcggaggctatggcatccgccgaccctacttgcacggccgtgacgcactgcgcataactgctgcgctcctgaatccgagcctgcgggtggttgccgcggaagatgccgactgtctcgtcacctttcactgcgcacaccgtgccgtcgcctacgtcgcccaccgaacctgcgtcattggtgaatcggccacgctcatccgacctgaccagcaaaccgacgctggtcgtgaggtatggtccggcaaaatcaacgatcgcactggacccatcggtgataggccaagaggcgacgaccatgtcgacctgtccattgtccagcatggagcgccggttttcggggcgaacctgtttgaagacgatctgcttgttcgcatagccgagtttggcggccacgtatttggcgatggtgatgtcgaagccctggtatgtgccgtcatgccatgctcccaccgatggttcgtcggctgcgaccccaatggcgatggtgggcccctccggcgctccggagacggtggtgacttgaatttggccgcaaccggccagaccggataatggcaatatcatgccaaaggccgcggcgaatcctgccatcagtcgggagcgaaatccgcgccgcatcggacggcgagcgcggagcatgctacggctggcgaacgatgaccagtggtgcataaccgtcaaacgccttacttgaacatgcgcgaacgtgtgaggaaccaggcaaccgcaccggaaagcaccatggaaatcacgataatgagcatgaaaccccacggcttgtcagtgaacggcatacccatcatgccgccatcgaagttcatgccgtacatcgagaagatcagggtcgggatggacagtgtgatggagatgatggtgaagatgcgcatcacgttgttcaggttattggacacgatcgaggcgaaagcgtcggtcatgttcgcaagaacgccgctgtagatgttggccatctcgatagcctgcttgttttcggtgatgacgtcgtcgagcaggtcctcgtcgtccgggtattgtttgatgcgttgcagggtggtgagtttctccatcacgatttcgttcgatttcagcgatgtggtgaagtacaccaaggtcttgctcagctccatgagcatcacgatctcgcggttctgcatggagtggcgcagcttcagttcaagcttgtcgctttcgcggtcgatgatgcgcaggtaacgcaggtacatcgtggcgttgcggtacaggatctgcaggatgaagcgcgaacgcatgaaggtgttgaagcctcggatcgtgccttccatgaatgggtggagcacgggcgtgtcctgcatgcagacggtgatgatgaggttttcggtgacgatgatcgacagcgggatggtctcgtaccagtcgcgtccgccacgctcttccacggtgggaatgtcgacgatgatcatcgtgtaatcgtcttcgacgtctacacgtgaacgttcctcgtcatccaaaggggcgcgcaggtcggccaggtcgatgccggtttgcgaggcgacggtggcgagctccacatcagtgggttcgctcaaacataaccaggagccgttttccggtttctcgatctgctccacttggccattgattgagctgaagattctcagcatgtcgcctcacccgccttccgcgctttcctactgttctatcgctgtacggttccaaaccgagattagtctagacccaccgttcgaatttgcgagcggggtttcgcatagcgaccgtcaccagacgattggctgccaacttggcatgtgcggtcctcgcagatcggtcggcccgttctcccagtcggcgctgtcggcgatggcgggagccttgttgtattcctccaactcccacaggggctgttcggtgggggtgccgttgacgctgtggcgcactttgagccggcaccagcaggcgttgcgcatgccgccgagtgcgttcatgccgtccgggtcgagttcgagcaggttggagatggtggcggtaatccatgagccatgggtgacgagcatcagcgtggtgggcgtgctgtctgaataggcggagtcggtgaccagtgcgcgcacggcatcggcacctcgctggcccacggcggcacggctttccacaccatgcttggtttcgcccccggtgtgctgtttccaagaggcgtagtcgtcggctgccacggctttgatttcggcgcgggtcatgccttcccactcgccgaagctgcgttcacgcagtcgttggtcacaggtgactggcaatcccaaaatatcggcgaaggcgtgtgcggtctgttgggcacggaacaggtcggaggtcatcaccaccatgcgccggccggcggcgggagcctcctcgaactgtcgcgtatcagtgcgttcggcggcgtcaggaccgggctgggcgatggcttcgggatgctcggcaagtcggttcaccttggcccagtaataccgtgaagcgagtgcgaatccggtctggtcgacctgccattggcctacgatgtcgagcggcacatcgatctggccttgcaagcgatgttcgagattgtattgcgtacggccatgacgcagcatcatcacttcatcgatcatcggttttcgccacctcgttctcttgcggtttgccatactcatctcagcacaacccctagaatggcggcatggagatttctgagtcgacttgggcgttcatcgccaaacaccgccgtgaagatgtgcgtgatgtggccttgcacgccaagcatgatggcgacgtggatgtgccgttcgcgctggagcagattgccggctggcagcgcgcttcactcaagctacctgactgggcgtcccatgatgggctgattttcccgccgcaagtcccaatggaacaatgttccagccaattcaccgcacagtacaaggctcggctggcacagcgattgttggccgaggaagcagtcgacgacgattccccgacatccctagtcgatctgaccggcggtttcggcgtcgacttttcttacatgtcccgagtgtttgaccatgccatatatgtggaacaacaatccattttatgtggtatcgctcgccataatttcccgatactcggccttggccacgccgaagtcatcaatgatgattcaacagcagtgcttgatacgcttggccgagtctccatgatcttcctcgatccggcccgccgtgacgatcatggctcgcgtacctacgcgattgccgattgcacgccggatgtgctgaccctgaaggatatgctgctggccaaggcaccgacggtcatggtcaagctctcccccatgctcgactggcataagaccgtcgccgatttcgccggcgcggtgcatgaggtgcatatcgtctccaccgggaatgagtgcaaggaattgttgttggtgttggggcgcggccgttgcgtctcaccgctcgtggtatgtgctaatgacgggcaggtgctgtcgtacaaggccggcgataacagcgacaatcacacccctatcagcgattctgccttggttgcacgcaatacttgcaataccgaagactccctgtctgaggaaagcgcgaacggcttcgattcctcgcattggaagtacctttacgagcccaacgcctcaatcatgaaggccgggtgctttgatgttctcgaacagcgcttcgtcgtgcatcacatcagcccgaatagccacctgttcgtggcggccgaacctattgccgattttccaggcaggtcattcgtcatcgaatccatcgtcaccatgaacaagaaagaactgaagcagctattggccggtctcacgcacgccaacatcgccgtacgcaatttccccctatccgtggcccagctgcgcaaaaaactcaaactcaaggacggcggcaacacctacctcttcgccaccaccgacgcccaaggccgtcacctagtactgcgcactgaaaagcgaaaaagtggctccctctgacgaggaagccaccaatacgtcagctaatcagtccttggcgatggtcttgccggcggtcggaccggaggcaaggttctggatctcggtgacttcgagaaccggaatcacggccggcttcttggtgcccttttcctcggcgatcttgacctgctcgttgtagatgtcgtcgtcaacgtgcagcaccacgttgccgcggaagcggtagccctgcttcttctcgaggttggcgaaggcgatgaccagcggagagccgttcttgaggttctcgtagtgctggccggcggtgcgctcgtggtaggcgatgtgcgtgtcgtccagcacgaacagggacatcttcgggccgaggtccagttcgccgtccttggagacggtggtgatccagccgaggttgttcttgatgaattccttgatttccggagtaatgactgccatgtcgaatcctttcatgattgctacggataacgtatccttactctttccagagtaccggtttcgagcgcgactagcccggatgttcgctgtgagtaacctcaccttcgcacagctttcatccggttcttacctgcttggcgatgccgcgccccggccgcgcaccagccacacacctgtcacacacccgacgcccatcgaccggtcgattttggccggtagttcccgtaatctgtgagccgagagagccacaagttttcctaactgtcctgaggtgcaccatgggtttggtcgaacgtttcagcaagctgcgcagccgctggtcccgcagctttcccccgaatctcgcccgactcatgttgctgggctgcgctgcattatggggtggcagttatctgctcgccaaattcgccatggaggcgattccgccccaatggctgatgggtctgcgcatgataggcgcctgcctgtgcatgctggccttgttccataagcacatcgtgccgtatctgacgccgaagatcattgtgccggcgctcgtggtgggtctgacctactggggcacgatggtcacccagaccatcggcctgcagaccattgaaccgggccgcagcgcgttcctgacggccgcctactgcgtactcaccccgttcgccacgtggattatttcgaaaacccgcccgaaggccatcaatctggtcgccggcgtgatctgtctgatcggcgtcggcttcgtctcgctgaagccgggcggttcgctgtctctgagcgccggcgactggctgaccatcgcaaccgccgtcatcttctcgttcaatctgacctgccttggtgtctacaccaaacggttcgaccctatcgccgtcacttttgtgcagttcggcgttgccggcgtattgttcatcatcggcgcgttgttcaccgaacccatgccgaacgccagctggctggcaccctcagtagtggccagcgtgctctatctgttcctcggcgccacgatgagtgcccagatcatgcagaacatcggtctggctcacgtgcctgcctcgcaggcgtcaatcatcatgtgtacggaaagtctgttcgccgtcacgttctccgcgttgttctggggcgagacaatcatgtggacttcgctggtgggctttgcgctgatcttcgtcgccgtgctgatgtcggtaatcaagccgaccaaacagtcgctgcaccggaactgacgattcagtttcggccatggatggtcatgggttctccattgccctgaaccgttacggtgaaggccgaggctcttgaaggcgtgcaatcggaaatcggacttggcatcgccaaactgcatttcgagttgggtgccggcaacggcagcttcgcttgggctgcatgacgttctgctgaacgtcgttttcgctccaagcgaaccaatttcggttgttctttgcgctactttgcgccactttgcgctgattcccactgctcatcggcaccatatttttgagtcattccacattccgctggctaggttttgaaggtctcgtgtaggcatcctctcggtatcaccgagccttaagcaaccttccagcccgacactttacggtcgtgtcttgtgaagaagtttttcgaaggtctttccctctcatccatcgtggcgggcacccttgccgccgtcacctcattcttactggcatcgaaaatcggtatcgccggctcggtaatcggcgcggcagccagctacatcgtctccgcggtggccaccaaaatctatcaaaacatactcaccgcctccggtgagaaactacagtcggcctcgtcttccggcaatgacgatgacactacggataataagtccgataaggcagccgaatccgagtccgatacgacgatgaccggcatggtcaataccgtttccaccgcgcgcaagccgcgcgaagtcgtgtccaatcgagcgaacggacgaacctattcggtcaatgaactgcgcaaggcccgctcccataattcgaagcgcaccgccattatcgtcacgctggtatccggcctgctcgccgtggcagtaaccgccggcatcgtcatgctggtcacgcagggccgtggcacggaccatatcatcactccgtccaccacgcccacgcaaaccgacaccaaaacgcagaccgacacgtccaatcagaataacggactgccgcagccgggcattaccgacggttcgaatgattccaacaccaaagactccacatccggctcgtccaacgacggcaccgattcaagcacgtccgactcaaccggcaccgactcctcaaccgattccaacaccaatggatccaccgatggttcgaccggcaccgattcctccactaattcgggcacgactggcggttccaccggttccggcaccaccggaggcaccaccggcaccggcaacggttcaaccggatcgggttcaggatcagccaatggctccggttcctcttccagctccacgggcggatcatccagttcaaactccggtaatagcggttcgagcggctcctcaaccggtagcagcagcggaaccggcatcaaattcattggctgacaatcgccgactcgatagcagcgatggcggcaatgccagtcaatgacgtggggcaatgagaacatggaacgtatgactaccatcattatgaatacctctgagggcagcatcaccatcaacctgttcgacgacaaggctccgaacaccgtggccaacttcctgggcctcgccaccggcgagaaggaatgggcggacccgtacaccggccagccttcccacggcaagttctacaacggcctgaccttccaccgtatcatcaagcagttcatgatccaaggcggctgcccgctcggcaccggcaccggcggccctggttatgagttcgacgatgagatcgatccgagcctgaagttcgacaagccgtatctgctggccatggccaacgctggtctgcgccgtggtatggacggcaaggtgcacggcaccaacggctcccagttcttcatcaccaccgtgccgaccccgtggctggatggtcaccacaccatcttcggtgaggttgctgatgacgcttccaagaaggttgtcgacaagctcgaggccgtcgaaaccgattcgatggatcgtccgctcgaaccggccgtgatcctctccgtggacgtggctgagtaagacccaccacaaccgataacaaagccctctgatcgattccaatcagagggcttactcgttctcttggctcccctctggaggggagccagagtacggtacggactacttcatcttgcgcatacgcggctcggcggactccttggcaccggtcagacggtacacgtcgaacacgccgtcgatcttgcgcacggcggccagcagcgtgttgagatgctgcggatcggccatttcgaagctgaactggctggtggccacacggtcggaaccggtggcaatcgttccggagatgatattcacgccatgatcggacagcacgcgtgtcacgtcggacaacaggttgcgacgatccaaggcctcgacctggatcttgaccatgaacagacccttggtgctggtccattcgacctcgaccacacgctcggactgcttgttcttcaggtcgatcatgttctggcagtcggtgcggtgcacggacacaccctgattgcgcgtgacgaagccgatgatctggtctcccggcaccggcatgcagcaacgggccaatttgacccacacgtcgcccacgcccttgacggacactccggtagagctgctggaagttttgcgctcgatgggcttgagcggcagagcctcctgctcgacctcctcatcgacctcgtcggccccggcatccttgaccagatgcgagatgacgttctgcgtggagatctgcccatcaccgatggcggcgaacacagcgtcggcgttcgggaaattgaggtcgtcggccacaccgatcaatgcctcggtggtcagcagcgcattgaccggcaagttacgtttgcgcatagcgcgggtcagttcgtcgcggccttcctcaatagcctcggtacgacgttccttcgagaaccactggcggatcttgtttcgtgccttcgggctcttgacgaagctcagccagtcgcgcgaaggaccggcggtatcggacttggaagtcaggatctccacggtgtcgccgttgtcgagcgtggtgtcgagcggcaccaaacgcccgttgacgcgcgcgcccatcgtacggtggcccacttcggtatgcacggcataggcgaaatcgaccggtgtggcatgggccggcaaagagacgatcttgcccttcggcgtgaagacatagacttcggacgagccgaggtcttccttcagggaaccgaggaattcgttggaatctggggtttccgaagtccaatcggcaagctgctgaatccatttgagattgtcggcttcggaaagctcctggttcttctcgtcacgcctgcggtcggacttgtccggcgagctcaaggcgcgcccggcctgaccgttctccttgtacttccaatgcgcggcgatgccgaactcggcgcggcggtgcatgtcccaggtgcgaatctggatttccaccggtttgccgcccggacccaccaccgtggtatgcagcgactggtacatgttgagcttcggcatggcgatgtagtccttgaaccggccgggaaccgggttccaccgcgcatgcacggcaccaagcgccgcatagcagtcctgaatggtgtcgacgatgatgcgcacaccgaccaaatcgtagatgttcgcgaaatcatggccgcgcacgatcatcttctggtagatggagaagtaatccttcgggcgtccggtgacgtatgccttgatgttctgctcgtcgagatcctcgttgatctccgccagaatctgcttcaggtacacatcgcgctggccggctcggcgagccaccagcaccacgatctcgttgtagatcttcgggtagagcaccttgaagctcagttcctcgagctccgtcttgatggcgttcataccgagtcggttggccaaaggtgcgtacacgtcaagggtttcacgcgcctttttctgggcggacgtggtcttcacatagcgccaggtgcgagcgttgtgtacgcggtcggcgagcttgaccaccaaggtacgcacgtcgcggctcatggccaccacgagtttgcgaatggtttcggcttgggcggaatcacccacctcaagctgactcagcttggtaacgccatcgaccagaccggccacggtgtcgccgaattcggcgcggcattgatccaacgtatagtcggtgtcttccaccgtgtcgtgcaacaggccggctgccaccacgatcgggcccatgcccagatccgcgagaatctgggaaacggccaacggatggatgatgtatggttcgcccgacttgcgccgttgcgtgcaatgctggatgacggcgcgccggtacgcgcggtcgagaatggacaaatcctcatcgggatgatgggacttgcataccttcttgattggatccagcggattgagcggatcggcactgatctcacaacccaacttacgggcggcgtactgctcgccatcaatctctgccatgccagtcacctccctcgtcatgaagttcattgtagccgcgaaccggagccttgtgcatgcacctgttcgccatcattggttccgcaaccgtcgttgccgtcatcaccttggtcattcaaccggcccaatccggtcaggacgccactcccgtcgaaccgaacccacgttcggcgcgatcggatccgggcagtgtctcggccgggatgaaccgggcctcaacataccgctgaatcaccaattgagcgatgcgatcgcccggatggaagacggcggtgcgttccggatcgaggttgatcagcggcaccttgatctcgccacggtagccggcatcaacggtgccaggcgcgttgagcacggtgacgccctgcttggcggccagcccggaacgcggatgcaccaacgccacgtagcccgcaggtagggcgatggccacgccggtgggcaccagtacccgttcaaaaggcttcagcgtcacatcgacggtggtgatgaggtcggcaccggcatcgcccgcgtgggcatagtgcagctgggccggatgttcggggtcgaggctcttgaccaggacctcggtggattcgggctcgttgtaggtctcgtcgaacgccatcaggcggcgcactcctcacacaccggctggccatcctcgtccgtgtaggcgagctggctgcgatgcttgaccaggaagcactgcgagcagatgaactcgtcaccctgcatggggatgacggtcaccgaggaatcctcgttgctcaaatcggcgcccggcagttcgtagtcttcggcgatggcgttctcatcgtcgtcgatgtcgctcgaggcgttctgcgaggacttccccagcgcctgcagcgattcctcgtcctcatccttattgcggggggaatcataatcctgagccatcatggtcctttcgtcgtctttggttcgtaagtcgatatatatatagcacggtcagcgccgtactcgcccataggatacacgatttgaaatactcgtaaagttcgacacgtggggcatacttaaaagaagtaatgtctttgcgacggaaagtggtgcgaatatgccagatgatcggcttgaaaaagcccgtttcgtacgcgtgagcaagacgggggacctcgtattctccattggcggcagggaaatggccgtgagcgtggacgacacgctcgaacgggcgattcttgaggccaagcaggtcagaagcgagacgcgacaggccccccagccgcatcagcagtccactttgccgatttcccagatacagtcgctgattcgcgccggtgccgatccggcccgtgtcgcggagaaatatcatctgagcgaaacgctggtacgtcgtttctccatggccgtggagaccgagaaacagtacgccatcgaacaattccttgccgtggcggcacccaaagacagcagggtgcgcaccatcagcgaactggtggaacgcacgctggcctctgctggaatcggcatggaatcagtgacctggaaatccacccggcgcggacttgagccttggcgcatcgtggcgatattcacttccgcgggccgtgagatccatgccgaatggacgtggaatatgcacgacaattccgtgatgagcctgaacaatgccgctcgaaaactgctcggcgaacagaatccggaatcagccacggattccaaactcaagccgacgattcctgaactgcccggcgactccgtacgttccgcgcgtatcgagcgcgccgtgtctgcttgggcggcgcctacgccttcgattccggccgcacggcctgccgcgatccggccctccgtcacttccacaggttccatgcccccggtggacctatccacgtccatctcaccggccacgaaccaggctcatgacgctacggcccccagcccggtctcttcgcagaccgccggacctgtttcgtcatctgccgcaggattgcagcaatcgcctgccacggcaccagagcagggttctgacaatatttcggacgagaccgtacggcgtggccccaatgcacagctggtagccaccgagcaggagcgggcggccgaatccgccgccaccaaacacgaggcaccagccaaaccggccaagcgtaaatcaggacgttcggccgtaccaagctgggacgagattctgttcggagactgaatttccgaatcaggccatatcgatcaggcagggaatatccatttccaatgccgtttgggagccatgcacgctcggcaggtgggtggctttgtctccttgcgtacgcgaatcgacgagggtcacggctcccgctgcctgcacgaccacatcgccgagcatcggccggactcgctcgcagaccggtccaaacaatccgtccgcgatggcctcatccctggtccgcaccaaggctcggtcttgcaggtaatcgcgccaccggcaagctatatcttcaggtcgttcatccggctcggcatacagcatcagcgagcgcggctctcccccgaccagtgacacgcctcgggtgagctgcggttcaacggcgatgtcaatccgctggcccatgtcggtttgcaccatgccgtggtcggccacgatgacgatcagcgtgcctttgggtgcgctgcgtttcaggagcgcgagctgggcgtcgatatgttcgaatgcggccacccagtgttcggaatcccacccgtaattgtggccgactttgtcggcgtcacggatgtacaggtaggtcaggccgggggtgcgggaggcgcgtgcggcggccagcacacgatcgcgtggggtgacgttgccttgatagtcggtgcctcgcaatgcggcttcggtcaatggcgatttggagaacttgggcaaccccgagctcgtgacgcgcacctcttgagccgcaagtttctcgaacaccgtctcctcgcgctgcaggtcgagcggatcgaccatgggcggcacaggaatgtgcggattggctggtttgggtgccagcgcgtctttgaactggatgagttggatgagcttatggctggcgggttcgagctgcgtatagcccgccattgcggtcagtcccgggcaggttccggtaccgaatgcggccatggccgccacagtggtgcttggagcgcaggtagcgatgggacgctgattggcgctttcgttcatcagcgaacgcagatagggcgcgtggccgaggcgcatggcgaggttccagtagcccaggccgtccacgagcaccacgatggccgattcggcatcgggcagccccaacgcgcgctggcatgccttgggatcggcgtggaccttggtgggggccggatgtccgatggcggcggacaaggcgggcagcacggcggacaggtgcagtgctcccccacgccgatcggccggggcgtcatccccatagcccactgtgggcaccagccgcagcaactcgtccatatccggcgtctcaacactcatagttgcccattcaagtagcacccctccccttggctcagtgcgcagagaacggttctcaataacaactgtgcgctccaacgcacataatcaaacaaacgcacatcgactgaaacactggaatcacgccgttttatcggcaaacatgtgcgattggcgcaccgaaaccagcgcacagttgttatcgagaaccgttctctgcgcactgtttcgcgccctcccgctaatatgggggcgttcgaaagggagtttcatggcatcacaccgcaaaccgtccgcgcaaacctacaatccgcgcacggtcaaggagcatatcgtcgagacaccgctgaacgaggagatgagcaagtccttcctcgagtatgcgtattcggtgatttacgcacgcgcactgcccgatgcgcgcgatggcttgaagccggtgcagcgccgcatcgtctaccagatgggcgagatgaacctgactcccgaccgcccatatatgaagtccgcccgcgtggtgggcgaggtgatgggcaagctccacccgcacggtgattccgcgatctacgaggccatggtgcgtttggcacagccgttcgcgatgcgtctgccgctggtagacggccacggcaacttcggctcgctggatgacggccctgcggcctcccgttacaccgaggccaggcttggcccagccgctctcggcatgaacgcggatatcgatgaggacaccgtcgacttcacgccgaactatgacaacaagctcaaggaaccgaccgtgctgccggccgccatcccgaatctgctggtcaacggcggctcgggcatcgccgtgggcatggccacgaacctggccacccacaatctgggcgaggtggtaaacgccgccaagttcctcatggcgcattcggacgccaccctggaacagctgatgcgctacgtgcccggccccgactggcccaccggcggcacgatcatcggccgcgacggcatccgtgaggcctatgccactggccgtggtacgctcaccacgcgcgccgccacgcatatcgagcatgtcacggcccgcaagcaggccatcgtggtcaccgagctgccgtacatggtgggcccggagaaggtaatcgaacgtatttccgacggtgtgaagaaccgcaagctggaggggatttccggcgcgttcgatctgaccgatcgtcataacggcacgcgtatcgtcatcgagatcaagactggtttcgacccgcatgcggttctggtgcagttgttcaagcacacaccgttgcaagacaacttcgccatgaacaacgtggcgttggtggagggccgcccgcacacgatgggtctgaaggagatgcttcaggtgtgggtggaccaccgccgtgtggtgattcgccgccgcagtgaatatcgcaagaagaaggcgctggagcgcctgcacctggtcgagggcctgctgctggccatgttggacatcgacgaggtgattcaggtaatccgcacctcggatgatgcggatgccgcgaagagccgtttgatggtcgttttcgatttggacgaggtccaggctcagtacatcctcgacctgcgtctgcgccgactgaccaagatgaaccgtatcgagcttgaggccgaacgcgatgatctgaagaagcgtatcgaggagctgacccggatcctggcctccgccgaggcgctcgaccaggtggtcaccgacgagatggacgaagcggtcgccaagtggggctcgccgcgccgtaccgtgctgctggatgccgacccggatggcacgttgacgccggtcgtggcgcagggtgccggggcttcgggcgtgtccaagtccgcgctcgaagcggtgaaggccgccactacgatctcctccgccgaagccgatgtggccgcagccgcagctgcggccaagaagaccggcgaacagtccacgctgaccggagccttgaagatcgaggacgagccgtgcgtggtgatgatgagcgctaccggtttgattgcccgtaccacgccaagcgcgatggacgtgttcaatgcacgatccacttccgatgagcgtttgagagacgatcagatcaccacaatcttcgagacttccacgcgcgctacgtatgggctggtcacgtcggccggccgcctggtgctcgcgcatgtggttgatttgcctgccttgcccgctaccgccacattgtcgctgaagggaggagttcaggccgacgaactgatcggcatgaccgaatccaccgatccgattcgcggtgagcgtgtgattacggcgattgccatggagcagccgacgtccggcaagaccagtgccaaggacgagagcgaggatggcggggccgccgaggccaagccgttgccgtcgctggctatcggtacccgtaacggtgtcatcaagcgttggaatcgtgaggcacccaccaccatggattcttggcccgtcattgatctgaaagatggcgacgaagtggtattcgccgccgtggccgaggatgacgaccgtctggtgttcatctcctccgattcctcgctactgacctttgaggcgaagaacgtgcgcccgcagggtcgtactgcgggcggtatggccggcatcaagctggccgagggcgcccgtgtggcggccttcaacgtggttcccgccggcaaggtggcatggacctatgaagagggcgagaacggcttgacttccggatccggtgcagtggtgctcaccgtggccggcgattccgatgcactgcccggcaccgaaaacggcgcggcgaaggtcactccgctggaaatgtaccccaccaagggtcgcgctaccggcggcgtgcgttcccagcgattcctgaagggccagaacacgctgattcttgcctgggtgggcctctacccgttgcacgcctctacatccgcaggctctccggtcgagcttcccaagcccgatatgcgccgagacggttccggagtagacctcgcctcccccatcgccttcattgcgtaacctcaattaagctccctctgatgggccgagccgtaaagcaaacaccccagtggggtgtttgtaggcgaggagcgaacgatagtgagccaaacaatagagaagagaccctaaacccggcctacactaagcattaaggaggtggcgatgagactactggttgccgtatccaatgaaccgttggcccacgccattcatggtgccctgcttgccggtcgtcatgaggtgtctttggcaagcaccggtagtatcgcgctcgccgctgtcgccaaggagtcatttgacgcagtgattcttgatgaatccctgctcggcatttccaccgagcagctcatcgaatccctacgcaatgcccgtgcctccgtcaagattctgctgctgacttcgacgccactcagcaaaaccattggtgaaggcagccgctggcgagcgctgcctgacgagtacgcccctatcgaagagacgccctacagctccttcagcgcgaattcacgcgcaaacaactcagatgccgaagccgaacaacgctcggacaatgctgcctctagcgcacaagctaacatacgacgcccagatgccgcgctgagcaaaccattctccgatggcgaactgctctcatacgtcggctcgcttgccaccgactcccccgccatgatcattcgtggcaatctcacgttggacaccacgaatcacaaggcctactacgcatccactcacagcgcaatctcactgtcccgtctggaatacagtttgcttgaagcgctggtcaaggctgatggccagttcgtcaacaccagcgagttggtcaaacttatcggcggcccattcttcgagcaacagggcttactcaagaacgccctctacacactggataagaagctcacccgcgccggcctcatcatgacccaacgaggctccaactaccgcattcgatagctgggctcaatcagtacagccgcatgccttggggaacgggggtgaagccggactggtggaggatgcgggcgaaggggtgacgggcgttgaggggttcgccattgatatcgctgaatgtcacggagccggtgccattgcgtttgagggcgtaggccagttctgtggcggccttgcgcatttgttcgtcggaatcattgacagcggcttcatggccgaccgattgatcgaacgctgtcaggtgcttggctttggcggccgcgtatagtagcgcgccttgcgcattgagcacgaccgtggctccgatacggcgtgccggtttacccgcaccggcaggcgcgtccggccacgcgatggcggagccactgagatttgcggggtcgagcacactcaatgccaccacggactggccacgatgctctgacggatgacgcaacgcatccacggtgtcgcgctcggcaaattgggccgcgccgaaaccacggacgaacatgcctcgtaccagtcgaccatgctcctccatgcgattcaataccggatacaacgctgagtagccacccgggatattttccttgtcaatcaccggctgcgcgatgacgccatacctgtccagcaacgtctcgaccagtgcgagtgcccgttcggtctggtcggtgtcttcggcttcagcttgcccgattacggcggaccacaaacctcctaacgtcatatccgtagtggctcggcgaatcggagcgacacgcccacgacgacgtgatgtagtggatttacgcgggcttgctgcgcctgcggttaatgcacgcaccggcgcgaagctggaattggtgaccttaccttgccagaccaagctccacaaggcatccttgaactgctgttcgctccactcttgcggaatgatttcgccggtgtttggattgatgtccggctccgcggtctcattccacgcacgtttggcggcatccatcagttgacgggcatggaacgctccccctgagtccagtgcggtcagaatcgcttccggcatggtggcgtctgaggcgttcgatgtcgtaccatgttccacaccgctgaacaatattgaatccgccggatagaaagcaacctcaccggggtccatcgcactggttcccccggtttttgagccgacccagaccacatcgccgctggtcagcaactcatccagcaatgcaggttggtagtctcgtactcgtgcggggaatactgccgactcccagagtgcagtgggcagtgatatgccctccagctgctcgataacgcgcatgagcccgtcagcaccttcatatcgttcgccgccgaccggcccgataccttgtcggtcgataagaaacatctggaacgcctctggttctactggcttgactgctttacgcgccttggccaatgagcgagaccgaatacggcggaatacgtccttatggagccactgttggccttgctcgtcatcatctacaaagtggccttgcagcaactcgcctttggcagccagcacatccagagtgtgcacggcatccgtagcatcgaggtgtagatcggctatgagctgatcggcggtgaaaggaccatgggttttggcgtaacgggtcacgcgaccagtcacatcatcgtcggcaagctcattccagaaagtgtgctcccccagttcctgttcgacttcgcgaatcacgtccgggttgagcacttgtgccatatcggtggtgccgagcaagcgttcgagcacgtgcggatcgagagacagcagttgcgcgctacgctcggcctgaggttggtcatactggtacatcaccacgccgacgaagccaaagagaatgttctcggcgaaaggcgatggcgactcggtttccacgtccttcacggtaatggtgccggcttgcaatccggtcatcacctcgttcagggcgggcatgtcgtatacgtcttgcaaacattcgcgcgcggtttccagcagcagcggaaagttcttggccatacgtgcggattgcaggagctgtgcggcgcgcagtcgctgctgccataggggcacgcgacggcccgggtcggatcgcggcatgaacagtgatcgggcggcgcattcgcggaatcgtgcggcaaatagcacggactcgcccacttgacgctctacatctgctttccgaccagcaccaccaccccccgacccactcacccacaccaaacagcgaaaggcccaaaattatcctgagataactgatacgcatgaccgatgtaccgagtcagactggaatctttcgctacagcggcatcccatatccgtttttcctcggtataccacccttcagtcggttcgctatagccagtagacatattttgcgaaccatcattgaaaccatgtccagtccacggggaatatatattataatccgcacaggcttgggccattgccgtttcatacgcactccacttgagttcgttaagtccaagaccttttctgatttcattaacctttttcaatgtaggaatcgcttgaaccatgtgctccagttgatatgagctgcccgaatcattgggtctgatattaccttccgcaacagcttcacgatattgtcgactttcccaactatcactgtcaaagaatcctagagcatcattatatccatatgtctcatagaaacctctgccacctttatcccactgcgaagtggcattatccgcagccgttttctttgctgcggcatctgccgatgctatttgatatgcacgaacggcattgtcagcttcgctttgtttcgtgtcagcatctgctttagctttcgcttcggcttgcacggcactcttttgcttagcttcagctgccgtctgcgcttccttggctgattgcaatctcctagagacggcatcaatatcaatgatgtgctctccgccgaaagcattggcaactgcatcagctgtcgctctgttcacggcactagcgccacctaacaagtagacacgattcacaccactgctatgttcgtgcgcccactgcacggacggagaatctggcgtattcgccagcaacaccattgcgttactacgtcccgcaagtggacctccagccaaggcatcagggaaattctcacctgtagcaaataccgaattatttacggcagcattatgtgcgtacatatagtcagcaagcgcgcggctggtatcgtatctgttttccccgtagacacggagtcccactccgcctgaagttccatacatcagttgagtaatcaccagctcagggacagcgttctcaccacctacaacgagctgatgcctaaagttgccagatatcgctcgtaaggtttcagagctgaaaccgtttttcggattcgccaaaaatatcggcgccttttctgcatatgcatatgcactcacggatagcgcatcagcaaaattctcccctgtcgcgatgatagattcagcggacgaccactgaacccccaacctagctttgccttgaagatagatttgcaaggatgtttcgtatcgggtttcccccgaaatacggatggggacggaacctactaggccatgtattctactcacggtcgctctggatatcgcattaactcctccaatgataacagctttggaggctttaagcctcgttatctgttgttcagcctgcggagacaacacattaccactggtcaatacgataggagctttcaaagcacctgcaagtggtgccgctgccaatgcatcagggaaattgtctcctgatgccacaacgacatactctgaagttcctggaacctcagcttgtatgatacggctcattgtgtcatatcgagtgtcgccagctagacggattacattagtgctattggcttccacactcgatgcgggaatcacggctgcgccaatcagtgctgtgcatagaccggcaatcgtggtgcatacagcaatcttctttaaaatcatggccgaattccttcccatcgagacaatgcactgatgcagctgtcctatattccgtctctcctatgaggcagcgtatgccgtccatatctcataactcatcccttaatcttcggggcacctcaacatatagggcatagactacgaatgtcagttgtctcaattggatttgtcggacaacaagataccagtcaccacaacacatctggaacgcatgcctcgtcggcgatgagtggtcgttctgcaactggatggtcaccgggcataggaacaggaacgccggggcgatccagtacggaacgacacgcagaacgtcatcacggctcgcacgccgtcgggcggattctagtggtggttgcaacaccttcgttgctgtctgatcgtatcatgccgcgtcgagcaggtcgaggatcccgttgtctagatgaaagtgcaacacccttcaaattggagattgttagataaccagtgaaagggtgtcgcaccggctcttcgcattttggtgtgtatggcgtgtggttagaggtgggtttggatggctccgaccagcaccaccaccccccgacccactcacccacaccaaacagcgaaaggcctgcgaaatgacatctccgttcagagaggtaccgaatacgggaaaaaccaactataaacgccatcattgcaacacttatactcagcgtttcgtgcttcaggtacctctttgaaagcagttagcattctgcagaaggccagatgtacctctttgaagacagttagccctgaggcggccttgaaccatcctgaggcttgtcttcttcgtccttggtggtatcgccgggatcgacggtatcggcgtgcggatggatgaccgggcgcttgagatatcggctttcgctgggcaggtagacgcgatgacgttcgacggctccgggcagagtgacgttgaagcctaccgagagcagtcgcagcgccaccacgatgatgacgatcagcacgtcgagcagcatttccgagcgcatgtcgaaccagccgtagcttacgccgcgccataccagcacggtcaggatgcagccgatgaacgaaggcacagcatagaggtgtttgtctcgaataatcattggcacgtcgccaatgaagatgtcacgaatgaggccgccggccagtgctgtgaacatgccaaggaatacggctgtcatgcctgaggaaccgtaggccagagcttttgcggtgccgctgactgcgaatagtccgaggcccagagcatcgatgacagtcatcgtccatttgagtttggtgatctccggatgggccaccaccacgataatgccggaaaacagcgtggtgagcacatagcctttgtcggtgatgccgaccggcggcagggcaccgagcatcacgtcgcgcacaagaccgccgccgagtgcggtaagccatccgcacagcatgatggtgaagatgtcgtagcccttgcgaatggcggcaagtccgcccgataatccccaacacaggattgctaaatactcgatgaccacaaaaacgatgttgttctccaacgccacctgcatgagccactcccctctggtaccgcttcggttcgtctcagtccgtcttcgttctgttcccgttcatccttattcggcgctacagcccgtcgtacccgagcctacaacaggccttgcctgagtagtatggccggggaggaaggggccactaagacgtgaataggatggcaatgacgccagcttgccggtagtcgttggcaactcagcccctctaggttttacgatctgtaatcaaaaaacatgtatggacttaatcgttgttgatttctgattcaatcaaggcgactttttcttcgacatcacgcaagcgatttcgcagtgcggactcgatatcgatgccgtcaacgcgggccttgcgcacgacggcgaggatttcatcggcgtaggcatcggccttctcccgttcagcggaattgtcgccgcttgattcggattggttcgccgcttgaggatgtacatcatctcgctgagcatcagccgcagccggctcatcaaacgccgcgaacaatctatcagcattcggcgatttggagatgcgagaaacgactttggccgcgcgaggcaacgcaccttgagcgcgggaaatgccctcaagcacggatttacgatgcttttcctgctgtttcatcttttcccatagagccagcacagcttccggggattcgggttgggcagcttctcccccgtcgttactgtcagcatcaaaagcatcagaagaatcagaggaattgccggcatcatcagccgcaaacacatgcggatgccgagtgatgagcttgttcaccaaccgatcggcgacctcatcaataccgaacgggtcctcagtatccgattcgcagacccgcgcctgaaacacggattgcagcaacacatcacccagttcctcgcgcatgttgtcacggtcgtgagtctccaccgcgtcgacgtattcgtaggtttcctcgagcagattcttgagcagcgacttgttcgtctgcttgccgtcccacgggcagccgcccggcgaatacagcacatccaccacggccttgacccggtccagcgccgtcgctgcctcagccaccggcttcaatttcgagcagtgttcgaagcctgacggcaaacggtaggctgaagcatggtattccgtcatgtcactcatcttgctcataggtttgctcctgttctcatctggatgaaccataaccaccccccgcaacgtgcagaagacctagatcatattatttgttgcggaatgttgctaaatccatctgtatctctctagccaagaacatttccaatacgccaagaccccttggaattgttgctgttccaaggggtcttagtcagaaacaaaaggtgctagttcagcacaccttccacatccagttgtgcgggtcctcgacttcgccgagctggatgccgagcagctcgtcgcgcagttcgcaggtgagcttgccggagccgccgtcggcgacggtgacatcgaacttctcggacttgaagcgaccgatcggggtgatgatggcggcggtaccgcaagcgaacacctcggtgacttcgccggacttgatgtcctcgagcagctggtcgagggcaatcatggtctcgactacgtcgtggcccttgtcctgcagcagctgaatcagggagcgacgggtcacacccggcagaatgttaccggtcagggacggggtctccacgtggccatccttgtgcacggccatcatgttcatgccaccgagctcttcgaggtaggtcttggtggcggcgtccacgaagcacacctgctcgcagccattctcaacacccttgtactcgccgagcagggaggcggcgtagttgccgccgcacttggcgaaaccagtgccgccagggccggtgcggaaccacttgtcttcaacccagatgctcaccggcttgacgccgcccgggaagtacgggccggacggggaggcgatcacgcagtagtcgacctcctgcggggcgcgcacgccgaggaacggctcggaagcgaacatgaacggacgcatgtacagcgtgtactcgcggcgggacggcacccagttggcgtcgcgcttgaccagcgcggccacggaaccgaggaagtcgtcaatcggcagctcaggcaggtacagacgcttggcggagttctggaaacgctcggcgttcgcatccgggcggaacagccaggtggagccgtcggcatgacggtaagccttgaggccctcgaagcactcctgtgcgtagtgcagcacggaagcacccggatccatcttgagcggtgcgtacggttcgacgcggcggtcggaccagccttcgcccttggtccaggtcatgtgggtcatgttgtcggagaacacctggccgaaagccggcttgtcgatgagggactgacgcttctcatcggatgcggggttgtcgttcggcagtacggtgaacggttcggcgagcttgtcgagcgctgccggatcgtggtgcgtgttttcagtcattactagctacttcttcttgactttggcggcccgaaagccaccatatggggtgtgtgctgtgcgcttgtggcgcgagctctgttgcatacttttgcacacccatgtgttactcgtgtggcagagttcacatggtgaaaaacgaagaagcccgcaccgttctcaacggctgcgggcttccacgtttcagttatgttctgaattgttcgctatcgaagcgatcgactcacttggcgtcggcagccggagcagcagcgtcggcagccggagcagcagcttccggagcggcggtggactcagaagcatcttccggcacctcaacggtgacgacggactcttccgggtcctcaacgtcgagctcaacgccttcaggcagaacaacgtccttagcgaacaccttggtgccgtcggttaggccctcgacgctcacaacgatcttctcaggcaggttggcgacgtcagcgcgaaccttgagctcctgaatgtcgacgaatgccacagcagcgcccttcggggtgccttcaacgaagaccggcacctcgacgtcgatcttctcaccggccttgacctcaaggaagtcaacgtgctcgatgatgcgcttgaccgggttcttctgcacgtccttgacgacggccatcttggtgttgccgtcgaaggcgatggtgaacagggcgttggtgtgacgcagggccagggtggtctcgcgcatcggcaaggtcacgaaggcgggctcttcgccgccggcgtagatggtggccggaatcttgttggcaacgcgcagacgacgagcaacgcccttgccgaactcggaacgggcctcgccctcaagcttaatggtggtagccataatggatactccttgtagtttcgtttcgttctgtctcgctcagacgccacgacacgccgaaagacaccctacaaggagtgaaatacaccgagtcgataacggaagctgtgtcatgtgtcagcacgcacacttccctcgccaaagcaacaattgtcaagtatacgccaactccggactttggcgcggtgatgcttcgatgacactgcatcccggccgtcccagccacgtcaacgtacggtttccgcgaaataatccctaactttgtgaagaacgtacgcttacccgttctcaacgtacggttttcacgaaatcgtccgccatttcgtgaaaatcgtacgctcagcgacactcagtgtacggtctttcacgaagttggggatgatttcgaaaataacgtacgatggtgagtaccgtatcgggaggttgatatgactcgttcggacgacgtcatcaatgaggatggccatgacgtcatcgccgcacacactcgcgttgtcaggggtatggctgcggcacttgccgcgatagccgccacaggagccggcgtcacagccgcggccgccaacgtcatgttcacgttcgcgctggacaccaaggccaaacgttcgatgttcaacatgccgcacgaggagacaccgaaaggcatcgaattcgacatgtccgagcagcttgaggccgcccggtggttcgaggaggccaagcaatcggtcacgctgcgcagccatgatggattgaaactccacggctggctgttggacccggattgttccgacccacagccgcatctatacgcgatctgctgccatggctatgccggagagcccgcggaaatggccaaatgggcgcatcgctatgcgcaactcggttttacggtcctgctacccgcgcagcgcgcccatgagttgagcgaagggcgttacgtgggtatgggattgctggaaagcgacgatctgttgggctgggtttcgctgatcaccgcagctgatccggatgcacgcattctgttgcatggcaattcgatgggcgccgccacggtgatgatggcggccggcgatgcgcgactcccccgcaacgtcgtcgccgcgatttccgattgcggatacagttccgtggtctcgcagtttacggataatgccgaggcgatgttccgtttgccgcactcgttggccgtgctgctggtcaaagtggccagtcatgtgtctgaacgcaaggctggataccggtttgaggacgcctcctgtgtgaaggcattacggcacgcgactattccgatgatgttcattcatggtggagcggatacttttgtcaatccgaagtatctggacatcaattacaacgcctgcgccagcatcgaccgcgagaagctgctgattcccggcgccgaccacacgatgagcgccagcaccgatccggaccgctattggcgtcgcgttaacagctttgttaagcgggtgtttgggctgtagtagatatagagctcggctcccttctgtgaggggagctgccagcgaagctgactgaggggagcacccgtgtatgggctactcccctcagtctcactccgttcgacagctcccctcacagaagggagccaagaatggttacgcgagcaattccttgacggcggcgatgacggactgcagactcttcttcgcgtcaccgaacagcatctgggtgttgtcttcgaagtagagctcgttctggatgccggcgtagcccataccgcggccgcgcttcatgaccacgacgttctgggacttgtcgacgtcgagaatcggcatgccggagaccggggtgccgggacggcgagcagccgggttggtcacatcgttggcgccgacgaccagagccacgttggcctgcgggaactgcgggttgatctcatcgagatccacgagctcctcgtagggcacgttggcctcggccagcagcacgttcatgtggccaggcatacggcctgcgaccgggtgaatggcgtaggagacttccacgccgtggcccttgagcagttcgccgaggtcggcgagctcgcgctgggcctgagcctgagccagaccgaagccgggcacgaagatgaccttctgcgcgtagacgagctgaacggccagatcgtccggcgtggtctccttcatggtgccttccggaccgtcgccagcagcggcggcgtcagcaccaccgccgaagccaccggccaagacggagagcagcgggcggttcatggcctgagccatgaggatggacagggtcacacctgcggaaccgacgagtgcgccggccacgatcagggcgacattgtcaatcgccagaccggacatagccacagccgtaccggtgcatgcgttgagcacagagataacgacgggcatatcggcgccgccgatcggaatcacgaacaccaagccgtagcacagggcgaacacggtggtcagaatcgaccacagcagacgctgttcgggctggacgcacagcatgaccagcgaggcgacggacagtacggcgaacagaatgttccatacgcccttgcccggcaggttcagcttcttgacccacttgataccctgcagcttgccggctgcgatgagcgagccggtgaaggtcacagaaccgatgagaataccgagaccagcggtgatgagcaccacgatgtccggggtgccttccttggtcaggatgtcgttcagggccacgagtgcggcggcgccaccacccacggtattgaacacggagaccagctgcggcatatcggtcatcttcaccttcttggcggagacgacaccggccacggcaccgatcaggatgccgacgaccagcaccaccacggcgacaatgttcacgaagcccttggcgaagagcacgatgaacgccatgagcacggccacgaccatgccgaacgcggagatctggttacccttgcgggcggtcttcggcgaattcatgaaatgcagaccgaccacaaacaggacggcagagaacaggtagacgaaccaagcgacgatgtcgatggcgccaacggttgcggaggtcattacttcgactcccccttcttctcgttcttgctggacttgaacatctcaagcatgcggtcggtgaccacgtagccaccaacgacgttcatggtgcccagcacagcggccaggaagatgaacacgtaggccagcgggctattggcttcggctgccacgatcacaacgccgacgatgacgatgccgtggatggagttcgcgccggacataagcggcgtgtgcagggtggcgggcaccttgccgatgacctcgatgccgatgagcagcgcgaggacgaacagggtaatggaaacgacgagagtaggcatggtattccttcttccttacttctcggacttctcggcatcggcagcagctgccggggcggcggcgcggccggcaaccaccagcgcgtcgtcgagttcttcggtgagatcctggccgagcttgccgtcacgcacgaagtgcacgaggatgtcggccacgttgcgcgaaagcaggttggatgcggtggtggcgacgccggaggccaggtagggagcgccgatcagcttgacaccgccctcggtgacctgctcaccaacggcggagccctcgacgttgccgccgaggtcggatgctgcgcagtccacgatcacggcaccacgcttgagacccttgacgccggctgcagtgagcagcaccgggggcttgcggcccgggaccttggcggtggtgatgatgatgtcaaagccggcggccttttcgtcgacggcagcctgctgctgagcctgctcttcggcgctcagcgcgcgggcataaccgccctcgccctggcccttggagaagtcaagtcccagatcaaggaacttcgcgccgagggactcgacctcgccctgggaggcgggacgcacgtcgtacgcggtgacgaccgcgccaagacgcttcagcgtaccgatggcctgcaggccggcgatgccggcaccgagcaccagcgccttggccgggcgaatcgtgccggcggcggtggtcatcatcggcaggaaggaaccgtaagcatcggcggcggtgatggctgccttgtagcccatcacggagttctgagaggtcatctcatccatggactgggcgctggaaagcttacggggcagcttttcgatggcgatgcccaccagaccggccttctcgagcgcggccacgtaatcggcatcggtgaaggaaccgagcatgccaatgacccactggccggccttgagcttggccacggtctcggcggacggtcggtccacaaaaccgagcgcgtcggcttcggcgagcacctcgtcacggctggtcaccttcgcaccggccttttcgtaatcctcatcggtgtagtcggcagcaatgccggcacctgcttcaatcagtgaggagacaccgctcctcttcagccgggtgacgatatccggcgtcagcgcgacgcgggattccgtttcggacgtttcgttcaaaacgccgaacaccacggtggcttctgggttttgcgccatgagagccctttcttgttctacttcaaaatggacatggttatccgcatagtaagtgtagtcggaaggtaaagaccatgacttgagattccgccaatcgaaacagaaacgaacccgaaactagtgagaaatacgaatgtgtccatgtgcattgcggatgaattgctcggaagccgtccaacaatcacctggcatcgattagcaaccaagcgctcaataattatcgacaatcaccgtttcgcagctcacggttactcaacaatatcgggacctgtgcaatattttgccacgcactcccctaaccagccagaatcctacggttgcgtaaggtgacgagttcggtttgggcgattacaatttgagctttgagaagcgttcgcctcatggctggacgacactgaaaggtttacaggagcaagacttgtcggttatcaattccttcacgcagcacactatcaatctcacccgtaaggcgctcaggttgggatccgacttcgtccacccggtccacgacgacactccggacgagcccgattacctgtctaacgccgacgtgccggtcgagaccaatatcgctttgcctcacagcgacgattgggacgacggccacctgaccgtcaccgacatcgaccccgccaccggcctgctcaccacctccaccgaaggcaatccgccgctggacgaaggtacgtccatctacgacctgtatgcggaccgcgccgaacgtatgggcgatgagccgctgtacacctacaagtccggcaacgattgggtgaccgtcaccgccaacgagttcctggctgacgtgcgtgccgtggccaagggcctgattcattacggcctgaagaagggcgatgccgtggcattcatgtgccgaacttcctacgactgggacctgaccgacgcggcgatcatggcgtgcggcggcgtgctcgccaccatctacgacaccgattccgccgagcagattcgcaatatcgtcaacaactccgatgcccgactgctgatcgtgcaggacacggacatgcgtaagaaggcggatggggccgtcgaagagtgcccgtccctggagcacatcatcaccatcgagaccggtggcttggacgagatcaaggcctacggcaccacggtctcggacgaggagctggacgagcgcatcgattcggtcaagaagaccgacctgtgttccatcgtgtacacctccggttccacggccgcgccgaaaggcgtggagatgacccacgagcactactgccagaccgcgctgaatctgccggcctacatgcccgatctgctgcacgacaagaggaacaccatcctgctgttcctgccgcaggcccattccttcgcccgcgccatcaactacatcgtcgtctcctcgaacgtccgcatctacatcgccaccggcatcaagacgctgatcagcgatctgcaggtggccaagcccactctcatgatcgtggtgccgcgcgtgctggagaaggtgtacaacgccgcgtcccagaaggccggccacggccccaagggcgtggtgttcgcctccgccgtggtggccgcgcagaactatatgaaggaggtctccgccaatggcaaggcaggtgcactgacccgcactcgccgcgctgccttcgatccgattgtctactcttcgctgcgcgaagtgctcggcggtcgcgccaagtggattgtggccggcggtgccccgcttgacccggaactgctggccttcttccgtggcgcgggtgtgcctgtatacgagggctatggtctgaccgagaccaccgcaccgtgcgcgttcaacccgctgggtacgccgttccacgctggttccgtgggcatcgcattccccggattctccctgcgcatcgccgaggacggcgaaattcaggtcaagggtcgtgccgtgttcccgcgctatcacaagaacgacgaggccactgagctgtcgttcaccgaagatggctggtatgtcaccggcgacttgggccgtatcgacaacgatggcttcctgtacatcaccggtcgtaagaaggatctgattatcactgcaggtggtaagaacgtctcccccggcccgatcgaggaagtcattcagcgttgcgagttcgtctcccaggcgctggtgctgggtgataagcgtccgttcatctccgcattggtgacgctggacgaggagtcgctgcgcccgtggctggccgccaagggtctggacgagaacatgccgctggaggatgccgccaagaacgccgccgtgcgcgccgaagtgcagcagtgggtcaatcaggccaacgagggcgtctcccgcgccgagtccgtgcgcaagttcatcatcctgcccgaggagttcacccaggagaacggcctcatgaccgcctccatgaaggtgattcgtcccaaggtcatcaagcgctactccaccctcctcaacacccagatgtacacgaagcggaagtaaaccgtatagcaaaagctccctctgacgagggagcttttttcgtctatacgccctagaagccgaggcgttctagttgcttggggtcggactgccagcctttggctaccttgacgtggaggtcgagcttggctttttggccgacgatgcggttgaccggggtgcgtagcttcttcttgacgtaggtgaggttcgaggcgcccttgccgatgatgatcggcttctgggagtcacgctccacgtaaatggacacgttgacctgcgccttgccgtcatagccctgaccggtctcgttgtcttccggatagtcgatggaatcgaccaccacggccagcgaatgcggcagctcgtcgtccagggtctcaaggaacgcaccgcgcacgagttcggcgatggtgtcttccggacgctcctcgctgatctgatcgtccgggtacatctgcggaccctcgggcgtgtgctcaatgagcacgttcttcacttcagccagattgtcgtgcttcagggcgctcaccggcacgatgtccgagaaatcggcgaaatcgttgatttcgatgagcttgttgatgagttgctgacggccaagctcgtcgatcttggtgacgatggcaatcagcgggatgcgccacttgaacgtaccgtcctcacgcttggtggcgaagtcggtacgcagtcgggagagaatacgcttgtcgccggggccgatttcctgatcggcgggcagcaggaaggccaccacgtccacatcggccagagattcgtcgaccacgtcgttcagacgctggccgagcaacgtacgcggacggtgaataccgggcgtgtccacgagcacgagctgcgcgtggtcggcggtcaggatgccgcgaatcgccttacgggtggtttccgggcgagaggatgcgatggcgatctgcttgccgatcaacgcgttgatcaacgtggatttgccgacgttcgggcggcccaccacggccacgaatccggagcgatacggcacgtcctgcttggtcacgttctccgtctcaccggtcgcgtcgacttcggcaacgccggcaacatcggaagcatcggtgacgtcaatgtcatcgacgtcgttcgtgctgttgttctggtcggtcatatcactccttgctggcggtatcatcgccttcgacggactcgccgtcagtttcctcatgggtcttgttattttcctcgccgccctcgacgtgcgccggttcgacgacgatggtggacaccttcttgcggcgtccggcggagtccacggcggtcagtcgcagaccgcgcgtcacggccgaggcaccgacaatcggcacgcggcccagaatcttggtcagcaggccgtacacggtatcgacatcgtcctcatcaatgtcgatctcgaagatctcctccagatcggcaatcggcgtacgggcgggcatcttccacttgttgtctccgattttctccggctcagtacgctgggtgcggtcgtgctcgtcttccagctcgccgacgatctgttcgatggcatcctcgatagtcaccatgccggcgatgccgccgtactcatcgaccaccacggccacatgctggcgggaacgctgcatctcatggaacaggtcgtccaccggcttggattcgggaacaagcagcggctgccggacgatggattcgactgcgcgttccatggccgccgggttgaaggcggtggcacgcacggcgtccttcaaataggccacgccgatcaggtcatccacatcctcaccgatcaccggcacgcgggagaaaccggagcgtgagaacagtttcagcgcggaagacagtgtggagtcgcgctccatgcagatcatatcggtgcgcggcaccatgatctcgcgagtcaacgtatcagacagggtgagcacgttgcgcaacatttcggagacttccggatcgaagtcgttggactccaccagtcggtcgatggcggccttgccctgctcgagctgaatcttctcaagctcctcgtcgtcggacagatcggagtccttggagcggcggcccggccccttggaaccggacttgtcgccaccgatgcgtgcgaacggcgtgagcttggtggccaacgacacgatgcgcgagttggaaatcatgatgtcgaccggcttggccatgccggcggtgcgcgggcggaccagtacggagaccacggctacgataatcgcgaacaggaatccggagagcagttcaatccacagttccgcaccccacagggatgcgatggaagacaccagtacgccgtcgagcacattgcaggcgatgcggaagaacgcacagctgccggcggtggcgtaacggtcggcgatgagccgttgcacgcgatgaatcttgtcgatcttcttcatcttgaggaactggcttgcttcggagtcggtctgcacctcgaggatgagattgttaaggctggctcgcgttacgcgggccacggcgccttcagcggcggccatggtcagcgagagccagacgaacagggccgccacgagtacaagaatgacggtgatggcgatcggcgtggtactggaatactccataatgatttttcggtgtccttgaatgtccttgaacggtatcgaataatccggatttggtgtgattgatttgggagcttatttggaatcgaggtcgcggccagcaccgtgcgcggcgtcgtacagggccagcgcgtcgggtgtgccggcgggcagcgtggcctgcacgttggcatcgtggcgtagggcgaagaaggtgagcagcagctgtcgctgcaggccgaacatctggcgctcctgctcgggggtcacgtggtcgtagccgagcaggtgcaggatgccgtggatggtgagcaatagcatctcctgcatggtgctgtgcccggctgcggcagcctgttgggcagcgacccacgggcagatgacgatgtcgccgagcactccttccatcacggttttgccgtcgccggggcgcagctcgtccatcgggaagctcatcacgtcggtcgggccttcgaggttcatccaacgcatgtgcagttcggctatgggatcgggatccacgaacatgatggtcaggtcggactgggtgctcacgcgcatctggtcgagtacccaaatacccaaatcggagaagaccttggggtcgatgacccactgggtttcattggtgacgtcaacgctcatcgtctgtctcgctttggttggttgaatccgcttgctggcgggcatcgaagtcggtatggttgcggcggcccttgcgttcgatgtcgcggtggtcgccggcgatggcggagtgacggtcgtaggcggccacgatctgtccgaccagctggtgacgtaccacgtcctcggttttgagatgcacgaatgcgatgtcgttgatgccgcccaggatgcgttcgatggtggccagtcccgagcgaggcacggtcaggtccacctgcgagatatcgccggtgatgaccatcgtggtgttgaagcccagacgggtcaggaacatcttcatctgctgttcggtggtgttctgagcctcgtcgaggatcacgaacgcgtcgttcagcgtacggccgcgcatgtaggcgagcggcgccacttcgatggagccgtcgtccatgtaccgcttgagctggtcggcgccgagcatgtcgccaagcgcgtcgtacagcgggcgcagatacgggtcaaccttgtcattcagcgtgccgggcagaaagccgaggctttcgccggcctccacggccgggcgcgtgaggatgatgcggcgaatctgcttgtcctggaaggcacgcacagccttggccacggccagatacgtcttgccggtgcctgcggggccaatgccgaaggtgatggtgtgcgattcgatggcgttcacgtaggccacttgtccggcggttttcgcacggaccggcacgccggcagcaaaggtgatgacgccgggaaccgtgggcttgcggtacgtcgggtcgtgggagccggcagaacgtgcatgggcgcgttcgtttgaggtcgattgcgccagtttgtcacgcaccgggccgtgaccgggatgttcgaggcgcacgtggttcttgagcacgttctggtcgagcatgcgacgcacggtgtcggcgtccataggcgcggtgtaggcggcttggatgatggtattgaccaaatcctcggcctgtgcggcctgggcttcggtctgcttggagcgggagacgatcgccacgcggttgccgcgcacgataatcgtcaggtccggaaaggcgcgctctacctcgcgaatgacctcgtcaaccgggccgagcacggcgacggggtcaagttggggcgggatggtgatggtacgtgtagtcgttgccacgaagcggatattcccctactactcgtcgagcttttcgccggtcatcacgtgcgcgtgcacgtggaagacggtctggccggcgtcgagaccggtgttgaacaccagtcggtaggcgccgtgaaattccttgtcggcgatgttctgcgcaatggagacgatgtgggccagctcggtcgggtcaccggcggcaagttcggcgacgttggcgtagtgcttcttgggcaccacgagcacgtggaccttggccttgggattgatgtcgttgaatgcgtaggtcgtctcgtcctcgtagaccttgctgctgggaatctgccctgcgatgatcttgcagaacaggcaatcgtcggattcgctcatcatgctccttggtttgatgttgctacgcaccagcttagcgcgtgggcgttactcgtaacgtcccaacacccgagacaacagcgacaacgctacaggaccggccgtcgcggctctcagaatattgcgccccagtacgcagctcaccgctccggccttgacgaaatcagctacctcctgctcactgatgccgccctcaggcccgaccaccacactgacagtccgcggcaggccgtcctggagcgtgcgttccaccaactgcgcaaccttctcctccacgccggaccacgtatcggtagcatcctgatgcagcacaatcaccacatcgccatgcacgcaggccctgcggcagatggccacgacctccttgctggacgcacacgcctccagttgcggcttaaaggcgcgccgcgactgctcggtggcggcatccagtaccgaattccacttcttgtctgtacggccgaccttccacttggcaatggatcggtccgcctgccatggcaccacttggtcgacgccgatctgagtagccatatcgatggcctgctcatcatggccggttttcgccaatgcctgaatcagcgccaaacgggtgagcggctcgggttcgcgccccacttccacgacttcagccagtccggcttcaggatcggccatcactgcctggattctcaagccgttgccgtcggaaagttgcaggctgtcccctgccttgagtcgcatggcctgcacggcatggcgcttgatgtgagcgggcagggttagcttccagccggcgtggagttcgtcgctgttcaccgggacgtcgtcgacctgcgggtcgaaaagaaaaagggcatcagtcatgacttcaaggctacacgcgacacgccgggcacacgcgcgaattgcatccctgtaatttcatgctaagctatctactcgttgtccaaacgacacctgcccgggtggcggaatggtagacgcgctagcttgaggtgctagtgcctattttatacaggcgtacgggttcaagtcccgtctcgggcacagataaaccccttgcattgcaaggggtttttcgttatctgcacacacgaaaggccaccaatgcagttcatcacgctggacaccgtcgacgacccgcgcgtcgaagcgtatgtgagcctcaccgaaatgcagttgcgtaatcgcttggaaccagccaagggcgtgttcatcgccgagtcccccaaggttatcgaccgcgcgctggccgctgaccgcgaaccgctgtcactgctggtcgaggaaccttggctggagggcatgaaagacaccttcgacttcatcgacgggcgctggggcgcggatattcccgtctacgtggcctcacctgagcagctcaagcgtctgaccggctaccgtttgcatcgcggcgccctatgcgcgatgcgacgctggccgctgccctccgtagccgaggtctgcaggagcgcccgccgcgtggcagtaatggaaaacatcgtggaccacaccaatgtgggcgcactgatgcgttcggcggccgcgctcgatgtggatgccgtgctggtcacaccctcctgcggtgatccgctgtaccgacgcgccgcccgcgtgtcgatgggcaccgtattccagattccgtggacccgtatcaccgggttcaacgacgacggcaccgaaaacaagcattactggccgttccagggcatcgacgagttgaagtcgctgggcttcaccaccgtggccatggcattggaggatcgttcgatttcgttggacgaactgacacgccgtctgcacgcgcctgccgaagatccgacgcatatcgacaagctcgcgctgatcttcggtaccgagggcgacggcctgtcccaccatacgattgcccgcgccgatttgaccgtgaagattccgatgagccacggcgtggatagcctgaacgtggcggcatccagcgcagtggcgttctacgcgacacgctaaggaatcgcacgcgctccgaaaaggccggatccttaacaaatctacgaaactgttcatcgcaagttcacggcacgcgggggcgaaagccttgcatgttcgtttttttctgcaattattaactatgtaaaccgaatgcaaggaagcatccggcccggcagtgcggtgtcgaaagacgctcagtaacagagaggacagttacgatgaccaagaatcccaagattctgtcgattgtgcttgcaggtggtgaggggacccgcctgatgccgttaacccgtgatcgcgcgaagcccgccgttcccttcggtggtgtgtatcgtctgatcgatttcccgttgagcaacctggtgaactccgggtaccgtcaggtcgtggtgctcacccagtacaagtctcactcgcttgaccgccacatctcccaggtctggcgtttctccccgctgcttggctcgtacgtctcccctgtgcccgcgcagcagcgtctcggcaagcactggtatctcggctccgccgacgccatctaccagaccatcaacatcatcgaggatgtccagccggacatcgtggtgatcgtgggtgccgatcacgtctaccgcatggacttcgaacagatggtacagcagcacatcgagtccggcgccgagttcaccgtggccggtatccgccagcccatcgaggaatcgaaccagttcggtgtgattgaggtcgatcccgatcacccgaacatgatcaagaacttccaggagaagccgcccaccaccaccggtctgccggacaatccgaaccagattctggcctccatgggtaactacgtcgccaacaccaaggccctgttcgaggctctggctctcgatgagaaggctgccgacaccaagcacgacatgggcggcgacatcgccccgtacttcgcttcccgcaacgaagccggcgtctacgacttcaactcgaacgagattccgggctccacggccactgatcacgcttactggcgcgacgtcggtacgattaagcagttctacgatgcgcacatggatctgatcgcctatgtgcccgagttcaacctgtacaaccaggattggccgatttacacgatgtccggcaacctgccgccggccaagttcgtgcacgccggccgcgaccgtctgggccacgccaccgattcgatcgtctcccccggtgtgatcgtctccggcggtgaagtgcaccactccgtgctctcccccaatgtgcgtatccactcgtgggcacagattgtcgattccgtgctgttcgacggtgtagtcatcaaccgccgcgcccgcgtgtacaaggcgattcttgacaagaacgtggtactcaccgagaactccactgtcggcatcgataccgagcacgatctggcccgtggcttcaccgtcacgccggatggcatcacggttgtcccgaagaacaccatcgtcgatgactgattgaccagtccagacatggaaaagccccgcatcatgcggggcttttctcgtatagagctccctctgatgagggaacttactaagcgctatcagtactttggcatattgtcgaagctgaagcctagggcggcgagctggtcgcggccttcgggcgtgatgcgctccatggtccagcgcggatcccacgtccagtcgatgcggaactcctcgaccagaccggccagcgtggatgcgcattcgtcctcgataaggtcggtcagcgggcaggccggcgtggtcagcgtcatcgtaataatggcgcggcctagctcatcgatctcaatgccgtagaccagacccaaatcgatcacgtcgatgccaagctccggatcaatcacctgatgcagtgcctcgcgcacgtcttcggcagtggcgcggccgatatcgtcaatcgccttgatcggaatctcgctgccatcggactgttcgtcatcctggcaaccgcatttgccgtggtgaccgccacacgcacaggtgtcatcgccggacgcagcagagtgctcgatcgggcgtccgttcgggaagcccttggccaaggccgggttggccatcacgcggcgagcggcctcctcgtcctgcaggacgccgttgacagcatcgaaaacggacggctgtggttcgggaaccaaattatcgttggacatatttcctcagttctttgcagcgagggctttggcgatggagtccttcagcccttcccagcctagcagagcgcatttgatgcgcatagggtatttcgacacgccttggaataccacggcgtcgccgagcttttcttccaggttctcgtcgtccagaccggcaccgcgcgattccatcagcttgtggaatgtctgttccagatccatggcctcgtcaacggttttgccgtccaccagatcgaccatcaccgacaggctggcctgcgaaatggagcagccgtggccgtcccacaccaatcgcttgatggtgtgcggttcgtcatcggagacttcgacatggatggtcgcctcgtcgccgcaggtcgggttgaactggtgcgattcaccgggcgtgcagtattcgtggctggcttgtacggtgacattggccgctgcgtccgcggactgttcgaccgctgcgttgggcgcaaaggattccttgccatgcggatgtttcgacgcctcgaggatgacctcttggtacatctgttcgaggtcatccccgctcataccgaattcgttcatggtgttctgttttactccactccaaagaacttacggatgcccttggccgcttcgaccaacgcttgggcatcttcgaccgaattgtagacaccggaggaggcacggttggatgcgtataggccgaagtggcggtgtaccggctgggcgcagtggtgtcccacgcgaatcgcgatgccctgggcgtcgatgaactggcccacatcgtgcggatgcacgccggccacgtcgaacgccacggtgccgatgcggtccacgttttcgcgcggcccgaggatgcgaatgccatcgacgtcgccgagcttgagcagttcggcggcgatggtcttctcatgggcttcgatgttctcgagcccgatgttcatcatccattcggcggcgacgcctgcggctaccacttgggcgaccggctgggtgccggcctcgaagcgggccggaggggccatgtattgggcctcgtggtccatgtaggcgagctcgaccatggagccgccgaagttggccggcggcagggcttcgagcaggtcgcgcttaccgtacaggaaaccgacgccggtaggaccgtacatcttgtgcgcgctccaggcggcgaagtccacatcaagcgcgtggaaatcgaccttgaggtgcggtacggactggcaagcgtccaagatgaagatcgaacctacttcatgcgcacgcttgatgatcggggcgatgttggtgatggcacccgtggcgttgcccacgtgggtgacggccacgaccttggtacgctcggtgatgacttcgtcgaggttgtccgtacgcacacggccgtcctcggtcaggtcgatccacttgaaggtggcgccggtacggtaggacagctcctggaacggcagcagcaccgaatgatgttccgcacgcgagacgacgatctcatcgcccggcttcagggcaaaacgcttggcggcttctcccccacgccccagcgatgcattgccgaatgcggtggcgagcaggttcagtccggccgtggcaccaccggtgacgacgacctcctcttcaccttcggccgcattcgcgccgaccagcttggccaccttggctcgggcctcctcaaaggccatggtgctacgggcggccagttcgtgcgcaccacggtgcacgccggcgttaattgtacggtagaagttcgcctcggcgtcgatcaccgcattcggcttctgcgaggtggccgcagaatccaggtacacgagcgggtgcccgtgaatctcctgatccagaatcgggaactgcgcccgaatcgccttaaaatcaaccattatgttccccctacttacgtaacaattgtacgaaacgagtgggagtctgacatggcctgttcgcgaccgtaaagacctggcctaagcggcccggagcgtgtcgagaatagggcatgtcagactcccacggtcacggactcaggccagtgcggactcggagtcggcgccttcgggcaggtactggtcgtagccgttctcttcgagttcgtcggccagctcagggccgccggtcttgacgaagtggccgtcggcgaacacgtgcacgatgtccggcttgatgtacttcaagatacgggtgtagtgcgtgaccatgaggatgccgaactggttggcttccttggcgcggttcacgccttcggacacgatgcgcagggcgtccacgtccaagccggagtcggtttcgtcaaggacggcaaacttcggtttcagcagttcgagctgcagcacttcggcgcgcttcttttcaccgccggagaagccttcgttcacggaacgggaggcgaacttcgggtccatcttgaggcgcttcatggctgcggacaggtccttggcccactggcgaataccgggagcctcgccgtcgatttcggtcttggcggtgcgcaagaagttggtcatggacacgcccggtatttcgaccgggtactgcatggccaggaacaggccggccttggcgcgctcgtccggagtcatcttgaggatgtccttgccgtcgaggagggcctcgccggagtcgaccacgtacttggggtggccggccaacgtgtaggcgagagtggacttgccggaaccgttggggcccatgatggcgtgggtttcgccggagtggacggtcagggtggcacccttcaggatcggcttgatgccttccttggtttcgacgtggacgtgcaggtccttgatttcgagtgttgacattgttgtgctcctaaaaatgctgttcttacttgtcttcgaggacctgtgccatggcgtcgttttcgccacgggccagtcggcggtcaatcacggtcatcagatgttcggagatggcgggaatgccgatctcctcgacgagttcgccgaagaagccgcgcaccacgagcttgcgggcgtcggtttcggggatgccgcgggattcgaggtagaacagttcctcgtcgtcgaagcggcccaccgaagaggcgtgaccggcaccgatgatgttgccgttttcgatttcgaggttcggctcggaatcggcgatggcgcccggggtcaggaccaggttgcggttgagctcgtaggagtcggtgccgggggcggtgggctggatgagcgcgttgcccacccaagtggagtgcgcgcccttgccgtcaagcgcgcccttgtagaccacgcgggacttgcagtcggggtggttgtgtaccaccatcgtgcggtgttcgatgtgctcgccggggtccacgaagtagatgccgagcatgttgaggtcgccctgttcgccgccgaagtcctgatccatgcggatgcggacgatgtcgccgcccaaggtcacgacggagtggcgcagggatgcgccttcgccgacgtggatgcggtggttggccacatgcttggcggttttggcccattcctgaacgaacgtggtggagacgtgcgagtccttgccggtggtgatttccacgccttcggccagtcgtgcgtcaccgtcgtgttccacgacgacgtccgcatgagccttgtcggcggcggcgatcaccagatggaaagcgtcgaggtcctcccccgcgccgtgcaccttgacgagcacgggctgggcgatctcaccggacagttccagaatggttgcggtgcggccggattcccattcgactgcggagacgcggtcgttgggcttggacacagtgccggacaggccctcaccgagcttgatctggctgagcttcacgccttcggccaacggcgagccgtcaatcatggagacttcgatctgcgtttcgccggaaggcttgaacacggtgaagaactcgttgatgcgctcgataggcgtgtagcgccattcgtcctgcttgcggctgggctccgggtagtcgcctgcgttgaacgagcgcacggcatggtccacggaggacggcatagcggccggaatcgcgtacgggtcgttggggtcggcgaccggaatcttgatttccttgacgggtgttgtgttgtcggtcatcggaatcagcccaccgatccttccatctgaagttccacaagtctgttgagttcaagcgcgtattccatcggcagctcacggctgatcggttcgacgaagccgcgcacgatcatgcctcgcgcctcttcctccgtgagacctcggctcatcaggtagaagagctggtcttcggaaatcttggaaacggtggcttcgtgggccatcgaaacgtcgtcttcgcgaacgtcgacatgcgggtaggtatcggagcgggagaagtcgtcgaccagcagggcatcgcacacggtcgagttggacgaaccgtacgcgcccttgacgattttgaccagaccgcggtaggcggagcggccaccaccacgggaaatggacttggcgacgatggtggagctggtgtgcggggcgaggtgaatcatcttcgcgcccgtgtcctggtactggcccttgccggcgaagccgagggacatggtggatgccttggcgtacggttcggcgaggatgcaggccgggtacttcatggtggccttggaaccgatgttgccgtcgacccattccatcgtgccgccctcgcgcacgtaggcacgctgggtgacgaggttgtagacgttgttcgaccagttctgcacggtggtgtaacgcacgcgggcgtgcttttcgacgatgatctcgacgatggcggcgtgcagcgagtcctcggaccagatcggggcggtgcagccttccacgtagtgcacgtaggagccttcgtccgcgatgatgagcgtgcgctcgaactgacccatggccggggtgttgatgcggaagtacgcctgcaacgggatgtccacatgcacgcccttcggcacgtatacgaacgagccgccggaccatgccgcggtgttgagggcaccgaacttgttgtcttccggaggcacgacggtgccgaagtacttcttgacgagttcagggtattcgcgcacagcggtgtccgtgtcgacgaagatgacgccctgcttcttcaggtcctcctggatggagttgtagatgacctccgactcgtactgggcggccacgccggagacgaggcggttcttctccgcctccgggatgccgagacggtcgtaggtgttgcggatgtcgtcaggcagttcgtcccagcttttcgcctgcttgtcgattggcttgacgtagtacttgaagtcgtctgcgttgaagccggagagatccacaccccaatcgggcatgggcttttcgaggaacgccttgaatccacgcagacgcatgtcgagcatccactgcggctcgcctttgtcggcgctgatcgcgcgtacgacgttctcatcaatgcctcgttttgcggcttcgccggcggcatcagaatcatgccaaccatagttgtagtcgccgaactggctgatgatctcgtcatccttcttgatcttgtcctcgttgacgcgggtacgatcagccacatactggctcatctccacgtcagcggcggcgtttggtgctgtgttttcggtcaccatcctgccttccttgtatcacacttaatcctatgaaaacctagcagaacccaagtgcaaacactagccgccctgacgcatattggctgtgggcttgattacacgaatgcgatacagcgatattggagccgggcaagcttgtcccatgcacaccgaacatcgcgtatgcggcattatgtgtcgcaccactgcatgccgtatttgttacatatcacactgttgcatatcacacttggatatgcacgctcgtgcccatattgcaccagttgtagaaccattcggccacatcccatccgatacccacgcaaccatgagatccgttggcaatggagggcattacggcatccgctacatatccgccggcaatacggtggattgcgcaaccggaggagaagtaattgacgaagcccacgtctttgacatcccatgtttccaccgtgccatcggcaagattcagcgtgccgctcatatcttgactgggcaacttttgccatacgttgaagtcacctgtcggcgtacacatcatgccaacgcattcgccggtgacgttgtcgttgccctccgcgaccacgacattcaatgtcttgaccaccgtgtcattctcataggcatagagcttacggtcggacaggtcaatcgccacgcgatgagcgaccttgacttcctgtttgggatctaccttgccgtccacattcactgagccagttcccgtggccagcacctgagccaagcgagcaccaacctccgtatccgcgccatcggcaatcacaatgccatcatggccttctgtttcagtgctcagcacctcgccagcattattgacgacgaccttcttgtcttcacgttccaatttgagattcggcttgatttgctcgtcatagtattgctgcagcttatcggcatcaaagaccacgtagccattacgtacttcattgtctttcagctttgactgctggttggcgtcgatgcgcatggccgaacccagcatggacgcattcacggtggcgatgtctttatccgccaccttgatggccacggcattgttcactagggtttccagcgtggttttcgcctcatcggcaattgcattggtaatcgtcggttcggttacgtcgagttccacccgaacggtctgtggctggacactgcccaatgactccactgtggaaatggcttgcttcgcaatgctggtggcgttggctccctggccattttctcccgcaataacgttgaagccactgttgttatcgttcaatgcgacttgcgcgtcaacaggttcttgtgcatcaatgttcagcgccttatctaccacactgccatcagcgagctcgggattgatttgcggggccacatcatgcgtaatccagaacgcatactgttgccaccatgcgtcaccgcgttgggcattgatgacatcggatgcgattgcttcaccatcaacttcgatgccgagatctttcagcgtgaacgtcgccgactgcccctggtatttcgctcgtaccgcggtgttgtcgacctggtcgttgattaggtcgacaatctcctgctcggttttgccggtaactgaatttccccatagcgttgtgccaggcagcacgtgatcttggaagaaccaaacaccgccgccacaggcagcccccaaggcaaccagcagacaagcaatcaccacccacggccagatgcggcgcctcctcatctcatcgccctgaatggaatctgatgcagcagcatccacactgtctgccacagtgccgctgacggcattattcgcaccaaacagaggcgcaaactgctgggtcgagtcatcaaggtgttcggtcatggtcggtctttctgcgatggcctactaagcgttatctgcatactaccaacacaccatagaaacggtaattttttaccgtcgccttccaatacatcatgctgcatgctgctcatacaacaaaaaagacgtggtggcgaaacatcattagatatttcgccaccacgtctttaccgtatgtcttgcactacgccgatgacggcagccagcacatcatgccgcgatattatgcacggcacgaaagtgcgtcagcgcgccgcctgatggtcgagcgcggccttgaccaggccggcgaacagcgggtgcggcttggtcgggcgagacttgaactccgggtgagcctgggtggccacatagaacgggtgcacgtcctgcggcagttccacgaactcggtgagctcgccgtccgggctctggccggagatgcgcaggccgccttcgcgcagacgatccttgtaggccacgttgacttcgtaacggtggcggtggcgctcggtgacatgcgtggtgccgtacagttcggcgaccagcgagccttcctccagctcagccgggtaggagccaagacgcatggtgtggcccatgtcgcccttgccggccacgatgtccttctgctcttccatggtggcgatcaccgggttggcgcaatcgggctcgaactcggaagagttcgcgtcttcaatgcccagcacgtggcgggagtattcgatgaccatggactgcaggcccaggcacaggccgagggcaggcagcttggtttcacgggcgaacttcagagcgccgatcttgccgtcgatgccgcggatgccgaagccgccggggatcacgatgccgtcgacgttgtcgagagcggcggccgcaccttcggtggtttcgcaacgatcggccgcaacccacttgacgttgaccttggcccagttggcaaagccgccggccttgatggcctcggtgacagacaggtaggcgtccggcagatcgatgtacttgccgacgatggcgatgttgacctcgtgcttggggtggtgcacacgctccagcaggtcggcccattcgtcccaatcgacgtcatggaacggcaggccgagctcacgcaccacataggcgtcgaggccctcctcgaacaggatcttcggcacatcgtagatgctcggcgcatccacgcagttgaccacgccttcggcatcgacatcgcacatcagggagatcttgtccttgatggactgattgagcgggcggtcggagcgcagcacaagggcgtccggggaaatgccgagctggcgcagcatcatcacggagtgctgggtgggcttggtcttgagctcgtgggcggcggaaatgtacggcaccagggaaacgtgcacgaacatgcagttgtccgggccgagatcgcggcgcacttcgcgggcggcctcaaggaagggctgggactcgatgtcgccgacggtaccaccgatttcggtgatgatcacatccacgtcatcggaagcctgggcgcgcatacgagacttgatttcgttggtgatgtgcgggataacctgcacgcactggccgaggtattcgccggcgcgctccttgcgcagcacttcctgatagatctgaccggtggtgacgttggccttctggctcaggaagacgtcgaggaaacgctcgtagtggccgatgtcgagatcggtttcggcaccgtcttcggtcacgtagacctcaccatgctggaacgggttcatggtgcccgggtcgacgttgatgtacggatcgagcttttgctgcagaacatggataccgcggctgcgcagcaaacgaccgagcgaagatgcggtcaggcccttgccgagagaggagacaacgccgccagtgacgaaaatatgcttggtgacgtgttcttgagaattaccatgtgttcttctaaccatggaatttcactctatcatccgtgtatgacccggcgtgttcaccagacgcgtcggccccgacatggcgtacttgaacaatacgaatagtaggctcgtcaaaaagcatacgcaaggtcataatcacgtcaaacgtcttatccgccagctattgcaggtattggtcgagacgcactaggcctaacgcatataggacaaacgctgttttcaggtttttcagcgaggcccattcatcggcaccgtgcgcgttgccggcacctggtgcgatgaatggcggggtctccaggtcgatgccgtcgaccgccggcacatggtcggcatggaattcgggaccgaagttgagtgcgcgcgggataaagcgggcgtgggtgccgtcgccgacagccacgggtcgagcctcgcaaccgagcacgtcgttgtaggttgcggtgagcaactggacacgcgggtcgtcagcctgcacgtagtatgggtcatcgttaaggatgtcgacaatgcggccgcccgccgcttcggcttgtgcttgaatacgctcgatgatttgttcgtgtgcctggcctaccgcataacggatgtcgaagtgcaatacgatggcatcttcagaagtctcacctgataccgcgcctaataccttgtctgcttcagcgaactcattcgccggtataatcaaaccaccattggcggtagtcggtccgctttccgcattctcgcaatcgatacccaagccggtgccatatgagtcttttgtccattgggcaagcgcctgcgctgcagtgaggtcacggccttcgagcagaccggaccgggcaagcgccgtagtgagcaccgctatagcgtttacggtaccggacggctggcaggcatgaccggcgacaccggtggcctcaatcgtgacgccttgcgctgttgcgttgatatgcaatcgctcggcgatatctggagcgatgttgccgctctggcagaatgcttgccgcacggtagattcgtcgacgccggtgagggtgattgcggcggccccgggaaccgtgttagtggcggtgccggcatgccaaccgcgcaattgcggcccgaccggcagttcgacatccacatcgagcagccctttttggatattgttcaccgggaagggaccatcggtgacgatggcctggtacggcgcgccgatgttggcgacgaaccatttgatgtcgttgagcgcgatctcttcggagccgccgaacagtatacgtacgcggtggcggaaacggtggtcgtgttccttgaagaaacggagtaggaaatagctggtcagcgcgacgcctttattgtccaatgagccgcgaccgataacaatatcgccaataacctgcggatcgaaggcatcgtgcgtccaaccgtcgtcggcggggactacgtcgaggtggtcgacgaaggcgatgtcacggtcggtctccacgttctcctgtggataaacgacttccatgacgtggccggtgtagtcgcgcgtaggcagcccgtctcgtcctgccttggccagcatatggtcgaatacacggcgtacttcgggtccataaggcgcgcccggacgaggattcgggtccgattcgtcggaaaccgacgggtagcgcagcagctcacacagctcatcgacgaactgtgcgcggtgggcgtcaaaccagcgtgacgcggcatcgacgagatcacgttccgtggcggtgagagtcatggcttcctttacttggacgcttatggtttcctcaggtaacaggaatcccgggcgcaacgtcgactgctacccgggattggctggagggcttggttctattcgctcagcaagtgcgccacagcatcgagcgcgagcttgtagccgtagaaacccatgccggtgatggtgccggtggccacagggctgattacggaacgcttgcggaactcgtcgcgggcggacgggttggaaatatggacttccataagcggcaggttctcgtcaatgaccatgtgcgcggcgtcggcgagagcatacgaatagtgcgtgaaggcggcggggttcatgaccaccggggttttctcgtcggcggcttggtgcatccagtgcaccatttcggcttcgtcgtcggtctggcgcacctcgacttcgaggccgaggtccttgccccattcggtgcagagcttgcgcagggtgtcgaggtcttgacgaccgtagacgtcgggctggcggacgccgagacgtccgaggttagggccattgacaacgatgactttggtcattgggactccttttgtttgtgcttctctccctccgccccttcggggcacctccctcatcagagggaggtagaaggtaaatccgactccggggtacctccgttagaggggagccaagtacttttttctgaggggatggcgaacggcacggcctacggccgttcaattactgctggatacgacggaatgcttcttccacggcttcggcgggcgggttgtcgaggtgtacgacgtgaccaatctcgtcgaggaccacgaagcgcagctcattgccgcgggccttcttgtcgcgatgcatcaatgcgagcacgtcgtcgaacgagccgccattccacgacgtcggcagacccatcgaagcaagcaacgagcggtgatagtcaaccagatcctgatcgatgtaaccgatcagatgggccagctcggcggcatacaccataccgacggccaccgcattgccatgcctccagcggaaatgctcgagcttttcgatggcatggcccatcgtgtgcccgtagttgaggaattcacgcagacccttctccttcaaatcggaggagacgtggtaggccttgacctttaccgtgcgctcaatgagctcggcaaccacgtcttcgagcggcgagccgaggaatgtagagccgtcgaaagcgcgcagttcagctgcgtggtcttcgaggatatgcaggatttcggggtcgcggatgaaaccggatttggcgacttcgccgagaccctcgatgaagatgtcattgggcagcgtagccagcgtcttggtgtcggccagcacaccggcaggcgtgtagaacgagccgacgaggttcttgccctgcggggtgttgatgccggttttgccaccggtggaggcatcgaccatggccagcagcgaggtcgggcagtttacatagcgcacgccgcgcatccacgtggcagccacgaaaccggccaaatcggttgcggcaccgccgccaagccccaccacggcatcggatcgggtgaaaccttcgttgccaaggcgttcccaaatgccgttggccacggtaatggtcttgccgggttcggcatccggaatcacgatgtcggaaacctcatagccgccctgacgcaacagggcgcgggcacgatcggagtgtcgctgcaccggctgagtgtggataagcgcgattttggcgggtttgggtcccagcacgtcgaccagatggttcatggcaccttcgccaatgaccacatcatacggctcaattgccgctccggtaacatgcactgctcgctcagataccatatcaatcactttcttcgctgcgccctgaggcgtaagcccccgggtatggacatgaacgttggcgacctcgcggaatactgggtcacgctgcttgaacagttttttccaacgggagttggcgttgccattgagcatgggccggcctcccccacggttcgcgcgttccatggcttccgccggatcggcatcaaggtagaccacacgaccgccatggtcgatgtaggaggcgagggcatgctgggtggatggcgtcatgggagcgccaccgcccagcgaaaagataccgtcgaaatcctcaagcatatcggcgatgagatcggcctcgacctcgcggaatgccggctcaccgtattcctcgaagtaggagggaatcttcatgcccacttcacgttcgatctccacatcggcatcggcgaacggcagacgcaacatatgcgccacttccttaccgacacgtgttttgccggctcccatcatgccgatgatgacggcgcgggggcgtgcggtcataatctacgaatcctctcgacgattggtgagtacagttgctgatggttccgcggcagtcgtcacgaaaccatacgcccttcgttcagcgcatgtgctccggccacgaggcgagatacgactcaaggttgcgccgtgtttcggcaacactgtctccaccgaacttatccagcgcgtacttcgccaaagtcagacgcaccatggcctcggccaccacggatgccgcaggcacggcggtgctgtcggaacgctggttgatggcttgtgcggattcgccggtcagcacgtcgaccgtacgcagggccttggggatggacggaatcggcttcatggcaccgcgtacgcgaatcacctggccattggacataccgccttcaatgccgcctgcgcggttggacagacggtcgatacggccgtcggcgttgaccacgatctcatcgtgcgcctgcgaaccggggcgggaggcttccaggaagccgtcgccgatctccacacccttgaacgcctgaatgcccatgatcgcggaggccagagccgcgtccagtcggcggtcggactccacatacgtgccgatgccggcaggcacaccgtaagccagcacttcaatcacgccgcccaacgtatcggaggccttcttggcctcgttgatgcgttcgatgatgcgggcttcggcctctttgtccagcgtacggacaggcgaggcatcaagcgcttccagatcgtcgggggtgggcagaggcaggtcggggttggtctgcacgccaccaagcgccaccacgtgggctacggtgcggatgccgaacgcctgatccaagaactgcttggccacctcgcccaaagccacacgggaggcggtctcacgggcgctggagcgctccagtaccgggcggacgtcgtcaaaaccatacttgcgcatgccggtcagatcggcgtggcccgggcgcgggcggctcagcggcgcattgcggccttcgcgcggcaggtcatggtcgagtgcatcggcgctcatgacctcggtccacttcggccattcggtgttggcgatttcgatggccaccggcgagccgagggtcaggccgtggcgtacaccggtcagcagacggaccttgtcttgctcgaacttcatgcgggcaccgcgaccatatccaagtcgacggcgtgccagtgcggaaacgatatcgtccgtgctaatacgcacgccggccggcaacccttcaatcatggccaccaatgcttctccgtgagactcccctgccgtctgccaacgcagcataacttccctcgtttcatgtgtgtacgtctatgtgtacgtctagctaggggttaatgttaagccatgccatacctgttcacgctacccggtctgctatgtgggcttgcactgtccattgaggatgttcgtcatcggcgggtgccgatcgcgtgggtggctgcgggcgcgttgcttcagctggccgccgatttcgcgtatggagtggtggtgaacgacctgttcgtgctgttgcaggcgctgttgttcaccgtgctatgttgcctgatccagttcgcgttggcgttgctggtgcctcggtcattgggattcggcgatgtgaccgccttgatacctatgggattgtctgtcggactgtttggcctgttgcctgtggtggtctggtggctggcgatgggcgttgccggcatcacatggattgccttgtggacgcgattcgatccacaacgcacatcaccgacacatgcgggcaaggtgccgtatgtgccggtgatattggcgggcgcgattgtggcggtggctgttggggtgttgtcctagatttcttccatccgcttcgcgggagccccgggcttaagttgagcgttacattccctgcagtgctcccctcggcgagggagccaatgaagagactaacgtccgatcagcttccccaagcgaaggaagctaacgggatgactactggttttcggcttgccacttgcgtagttcggccacgttctggtcatgttcatcggcggttgcggcgaacttggtttcgccggtgtccagattgaccgtgcagaagtacagccaattgccgctttcggggtgcagtgccgcttgaatggcgttatcgccgggattgctgatcggcgtaggcggcagaccggagatcttgtacgtgttgtacgggttggactcgtcttgggtcatctcggtggtcacctgcgcgggcttgacgttattgccataggccacggtggaatccatgcccaacgacatgccctgctccaaacggttctcgatgactcgcgtcactttgccgtagtaatcggctttgttgacctcggcctcggcgatagaggcgatgatcatcacccgttcgcggtcaccgccggccggcacgcccaattcatccaacttggcgatacgcttatcgaccatggccttgaggatttccgaagcgctcttcatgctcttgacgttgtaggttcccggctccagccatccttcaaagctaccgcccgcttcattgggcagaatatccttaccctcgttcttgataatcgtgtcgaattcgctttgggcaatgccggaaagcttcgcggcgttggcgaacacatcggtggcacgttcaccgggacgaacctcgaggaagcccaccgcctggttggtgtcggagagaacgtcgatcactttggatgcggccatatgcttcttcaatgtgaacgttcccggatagagtgtcgtgctattggcgttgaccacgctggtgaacgcggcagtagacttgatgacttcggccttgagcagattatcggcgatctccgccgcgccttggccctcgctcacggtgaattcgacctcgccatagcccggtcccggatagtccgcgatggccgtcgactggttgctccgactgtcacgccatgcgatgagcttggttacgccgaaatagccgccgccgataagcagggcgacgatggcgatagcgatgataatgccactgatacgcttgcgcctgcgctgtgcacgtcgcttgcgcatctccctgcgggatttcggcggttctggcggctcggccccgcgcattggttctgacccctgttcgacccaatgcgtgttgtcatcaaagaactcgttaaaatcatcggtcataaccgatacctcactgctcccgggtacggtcgagtgccgtctgcaaaatcaccactgccgactgctggtcaaccaccggcctgtgcttgttcgaagctttatgggcctcgaacagctgacgatgcgcactgactgttgtcaatctctcatctatcaatgatacctgcggaatctgatactccgtagaatcactgtcttcactctctgcttgcagcctcttctccagattggccgcccacctgcgcgcttttttggcgcttttgccttctgtaccgtccatctgcaggggcagtccgacgattacatggtccacatgttcgtcttcgatgacgttcaggacctcgtcaatagcaaagaaatagtcgccggcaacatgaatgttgccagcaggatgtgcaaaggtaagctccgggtcggacagtgccagtccgacccgggcattacccaaatcaacgcctaaccacaccactggcggaatcaggctttctgcgcctcgtgcttgagcgcttcgagggcctcgtcgatcttggaggcatcgacaccgccaccctgggcgaagtccggcttgccgccgccaccgccgccgaggaccttggctgcgccacgcaccagatcaccggccttgatgccggccttgcgggcggcctcgttggtggccacggcgaccatcggcttgtcatcctcgttcacgccggcaagggccaccaccacgggggcgtcttcaccgagctgggcgcgcacgtcgagtacggtcttgcgcagggcatcgaccgcgccaaagtggcccacgttcttgacggccaccttgaccggggccgcggagttcttggtgtcagcaaccagcgccggaaccgaggcggccagctgggactcgtacatggaggccaagcgacgatcggattccttgagcttggcgagcagggcgttcacacgctcggcgagctcgtccggacgagcgttgagcttgtcggacagctgggagaccagcgcgtgctcacgagcgttgaagtcataggcaccctggcccacgacggcgtcgacacgacgcacgccggagccgatggaggcttcggacaggatgttgaccatgccgatcttgccaacgtggtccacgtgggtaccaccacacagctcgcggctccagccgtcttcgccgatggagaccacgcgtacgatgtcgccgtacttctcgccgaacaggtgcatggcaccgagggcgatggcgtcgtcgaacttcatttccttggtggtcacggcgaggttgtcgcgcagcttgtcgttgacgcgctcctcgactgcggagatcacggacttggccggggccttggaccactggaagtcgaagcgcagacggttcggggcgtcttcggagccgcgctgggtggcctgcgggcccagctcctcacgcagcgccttgtgcaccatgtgcgtggcggtgtgcgagcgggcgatggcgccacggcgggccaggtcgatgttggcgttgacttcggcgccgacgaccagcgtgccttcggtcagacggcactggtggacgatgaggtccttgatgggcttctgcacatcgtcgacttcgagcacggcgccgtcgtcggacaggatctcgccctggtcggcgagctggccgccggcctccgcgtagaacggggtgcggtcgaggatgacctcgacgttggccgggccggtcacggcgggcacggaacccttgccttcctgcatgatgccgatcaccttggcgcgggcggacatgtcggtgtagccgaggaagtcgatcgggctgacgagcgtcttcttgaagtcgtcgtaaacggaaagatccacgttgtgacgcttcttgagggcgtcggcgcgggcgcgggacttctgctcggccatgagttcgcggaacttggcctcgtccaccttcacgccctgttcggcggccatctcgagggtcagctcaatcgggaagccgtaggtgtcgtgcagcttgaaggcgtcctcgccggccacgacgggctcggcggaatcgctcttggccttgttgacggccacgtcgagaatcgtggtgccggtctcaagggtgcggcggaaggcgtcttcctcgccatacgcggattcggacacctcatggaaggtgtcgttgagctccgggtagctggcctccatggcggccttggaggtcgggaagagggtgggcagcaccggatcggtcacgccgagcatgcgcatggagcgcacggtgcggcgcagcaggcggcgcagcacgtagccacggcccacgttggacgggcgcacgccgtcggacatgatcatcagggcggagcgcacgtggtcagcgaccacgcggaagcgcacgtcggcgtcctcgttctcgccgtacttcaggccggagagctgctcagcggcctcgatgaccgggaagacctcatcggtctcgtagatgttgttcttgccctgcagcaggtaggccagacgttccaagccggcaccggtatcgatgttcttgttctcaagctcgcccacgatgtgcaggtcggtcttggacttgacgttgtcgacctcgtagttctcgaacacgaggtcccagatctcgatgtagcggttctcgtcggcaatcgggccgccttccttgccgaaggcggggccgcggtccacgtagatttcggagcaggggccgccgggtccggggccaccggtggtccaaaagttgtcttccatgcccatcttctggatgtgctcggggtccacgccctcgttgatccacatggaacgggcttcgtcatcgtcggtgaacgtggtcatccacagcttctcggggtcgaagccgtagccgccctcatcctgcgaggtggtgagcagctcccaggcgtagtggatggcctcttccttgaaatagtcgccgaaggagaagttgccgagcatctggaagaaggtgccgtggcgggtggtcttgccgacctcgtcgatgtcgagcgtacgcacgcacttctggttggaggccatgcggcgcttcggcggggtctgctcacccatcaggtacgggatgaacggcaccatgccggcgatggtgaaaagcgtggtggggttcggggaaatcagggatgccgagggcacgatgagatggtcgtgcttggcaaaataatcgaggtatcgctttgcgatgtccgcagtgcgcatgagcggatgaactccttgtttgggtaatgggcgcagttgcgcctggtattggtggaaaagactggattatgaggattagtttgttctagctgattcagtgactagatggcaaggcggcatgcgcgtgtcagttggcgcgctcgatgtactgacggttgagctcagcctcgcgggctcgacgggtggcattgaactcgttgaccaacccttcgagtgttttcatcggcacattgtcctgatcggggccaagcaggaactggcgtgccgcatcaggcgtattggccttgacataggcctgtgccttggtgacggcaacgattccgatggccacgccgacgccgacccagaagatgcgtttgaacatcactcccccttctcggcggtgtcgttgacggtggttttcgcggcgttcttcgcaaggaaggactgacccgtggttttcagcgcgtagaaggtggaagcgatcttgatgatgggcttaccgaggaaggagccatacagatcggtcaacgcaccaacgttgttggcggtggtggaagccgcggcggaaatcttgttcacgtcttcgagcgacttgttgacctgcttgacggtggtcacgccttcgtccagcgcggggatggcgtgttcaccggactcccggaccgtctgcgatatctgatcaaacatcttgcccagcctgatcagcggatagatcatgaaaccggccaatactgcgaacgcgatggccgcgatcaggccagcgatctctccgactcccattgtttcctccttgcggtcacacttactcgcctaagggtagcactccttccctatttcttggcataccattgcatgcgcagggcgaaaaccgtgcgcgtgggcgtatgcggctataggcgaaaggctgtcctgctgacgctttcgtttgcggcgtgccgccgtggaccgtacgtgctattcgatatgtattgcttgctatttgctacttgccgtacgaaacgatggtcacggcttcgccgaacggcttgtcggtgtcgaagtcgatcacggttaccgaaccattggccgggcgttcgttcagatcgaggtcagggccgccgaaccggtgaccgaggctaagcagtgtgttgccatgcgaaatctgcagcacatcgtcgccgtccttgagattcgggttgtcggcgataagacggaacgcaccttcgacgcgcgtccaatattcctcatcggattccgcgtcgtggaagggatcggcttccttgagaaaatcacgcgaggcccccaacccgaacttctcgacgatttggttgtaggttttgacgccgtggggcgctcccgcggcgtaccaggccatggccatgtcaagtccctcgtagtagccgtagaactgctcgcggaagtgcatgtccgtcacgagtgcggggcgcgggttacccgcggcttcgttgatgtcgagaattttctcggccgtctgctgggcacgcgtggtgtccgaacagtaggcggcggcgaacgtcaatcctttcagtcgctcaccggccttgacggcatcggcgacgcccgactcggtcagcggcgaattcgaccatccctgcagacggttgtatcggttgaaataggtctgtccgtgacggaccagatgcagatgaagaatcatggttctgattatgtcaccattccggcggtttcggtgcgggttgccggaagtcataagtcataacggcataggtcactacctgagatatgcgtaatccgggcagtatacctaacgattcctgagagtacacttagaatactgtgagcataaccttgaaacctgcaccatctcgatcgtctgtgcctgcccatttcaggggtatcgatggactgcgcgctctggcgattcttggagtcatagcattccacacccgcccgtcgctattgcagggcggattcattggcgtgacgatgtttttcgttatcaccggttttcttgccacacgttcggtactgaacatggtggaccgcaccgggtcctttggatatggccgatatctgatccgccgcattactcgtttatggccggtgatgctggcgaccattgccgtggtgccttggctcacttggatgttcgctcccagcctgttgcagaaagtggtttccgattcgctgccgagcgccttgttcgccagcaattgggtgtacatcttccgcaaggtgccgtatttcgaggcggccggattgccttctcctctgacccatctgtggttcttgggcgtgacgatgcagttctatctggtttggccgttgctgatggtggtgctcggcaaaatcaccaagtccaaatgggtgcgctccatggcgattcttgtcatcatggctgcttccaccgccgacatggtgctgctgtttgacccggccaatacctcccgcgtgtattacggtaccgatactcgcctcgccgagctggccgccggcgcgctgttggctatctggattgcgccttcctcgcgaggtacggaagctgcggaagctggagcggcttcgcaaacagtgcagatcgaacgtcaggccggcgacaagacgggcgcccgtctcactatcgtctgcaatgttcttggcaccgcggctttggcggcactgctgaccggattctggttcgccaacgggtatctgtcgtacatgtaccaaggcgggtacctgattaccgcgttcatatcgttgtgcgccttggcctgtgccgtgaacaatgactcaatctggtcgcacgtgctgggttgtgctcccctacgctatatcgggtcgcgatcgttctcgctgtacgtcatgcattatccgctgctgcagttcatgaacccggcgacacgaacgcaggcgttgccgtggtggggttgggttcttgaggccgtcgtggtgttggcggcgtcggaagccttctaccagctggtcgaggcggcccgtaaatcggtgcagatgcctcgtagccaacacgccaagccgctgccgaaagccggctaccggctgcgcccgggcgcgtgggtcatgtcggttatcggattggtgaccgttgtggcgctgacgtgggcaccggtggactggaatggcatcgctcaagcgcgagccattcagctgcgccccgaactcgcggcacccgccaagccggtcaagaaaccggcgaagcccgagcccgagtcttctgccataaatgccgcgaacggcgaaaccaataccgctgacgcgaataagaacggttcggattctcagccgcccatcatcaaaccgattgcggaaaaggtgccaaacaatcttgacatttcgaagtacgcctatgatccggcaacggaaagctgcaacgcggatatgatgatggtcggcgattcagtgacgtcgggtacttcggacgccatccaggccgcattcccgaacgcttttatcgatggcctgccgaaccgtcagctgccgcaggcggtggatgtgtatcagcaggacaccgctgccggccacagtggcagtgtggtggtgtttggcctcggcacgaacggcgtgatttcgaatgagcaggaagtgcaacagctcattgacctgaccggcggcaagccgacatacttcatcaccatccgtatgccatacccgtggcaggagaacaacaacaatacgatgctgcgtgaggccgccaagaagaacaagaacgtgggcatcatcgattggcatgggtatagcgaaggtcatagcgaatacctcaacgatgacggcattcatccgaatatgaccggtgcctatgcgtacgcgacgatgattcgccaggcggtgtgcggccagtaatcgccctacaacgcaggaaccccgcggcttctcgaaagaagcgcggggttcgagcggtatgtcctggatttgttgaccagagggcccggatcagcgggcgtagaattcgaccacgtactggatgttgacctgcaccgggatctcttcgacctccggcttacgggtcacagtggccttcagggacggcaggttcacgtcgaggtagccggggaccgcaggcagcacgtcacggtgcacgccttcggcggcgatctggaacggaaccatggtctggctcttggccttcacctgaatggtctggccgggcttgacgcggtaggacgggcggtccacgatgttgccgtcaacgaggatgtgacggtgcaccacgaactgacgggcctgggcggtggtgcgggcgaagccggcacgcagcaccaggttgtcgagacgggtctcgaggtcggtcagcatggcgttaccggtctggccggcagtacgggtggccttctcgtaagcggcgcgaagctgcttctcggagatgccgtactgagcgcgcagacgctgcttttcgcgcatacgcaccgcgtaatcggactcggtgcggcggcggtcacggccgtgctcgccaggagcgtacggacgcttttcgaagatgcgctgagccttgggggtcagtgcgatgccgagggcgcgagacagacgcacctgacggcgagaacgctgaacgttcgtcattggattaatccttctgtcgttatctgaacggaacgcttgccttgcatatgcctaacaagcgctgagtcgggcctccccagcgcttcgtcgtgaataaacacgaacgggttggttttcttgcgattacctaccgccgacccgctgatgggctatgactccagacggtatctacctgttggcagacaccagcagaccatattacaccgaggctatggacagcactccggcgtccatgcgatacacccgatctgcgtattcgagtgcatcgggatcatgggtgaccatgagaatcgccgtgccgttgttggcttggtctctgagcagacgcattacgatgtcggtgctctcttggtcgaggtcgccggtcggctcgtcggcgatgagcaagctcggctggttcatcagcgcgcgggcgatggagacgcgccgcatttcaccgccggacagctcgcgcgggtagctgtctgccagatcggcaacaccaagctgggtgaacagcgtgcgagctcgggtggcgaacaggtccgaacggctcgcagccgtgtttgacggcgtgttttcctggtctgtgattggcgcaatgacatccggcatgaacgggtcggcggctgaatcggcggccgcttcatcattggtggcagcggcttgcgccacggcatccgttgcttctgcgttttgggcgaacggcagcggctccggaaacatcgttgcgggcagaatcacgttgtcgagcacggtcaggttgccgagcagggtctggctttgagtcacgaatccgatggtgcgattcctcagcacggacagtgctttatcgcccaagtcggccacattgcgtccagccacgctcacggttcccgaggtcgggcgaatcagcccagcgaccatgttgatcaacgtacttttaccgttgcccgaccggccgacgatggcgatgaattcgccggcatcgacggtgaggttcacgtggctgacggcgtcgaacggcgtgccgcggcggacgaactggcgggtcaggtccgtcaaggtcagcagatggtccggggagggcgtctcggttacgtgcggcgaatccggcgcagtcggcgcgttcggctgagctggcgtggtcggctggagcttggtcggctcaaccgtggtcggctgaagcggcgtagttgtcttagtcatatcactccccctctcgcagggtcaggtaggcttcgggccggccgagacgccacatggtggccagcgaaccgatgatgccgatgaccgtagagcacacaatggtcacggcaatgaatccgatcaccgcaaccgggctggcttgcagatacggcaattgaagctgtttgccgatcagcgaactgaatgggaaaatcaccaggctggccgcgccgacgccgattacgccaccgatcagaccgatgatggcggattccttcagaatgatggcattcaacatgccgcgcgtggcgcccatgatgcgcagggacgcgaattcgcgtttgcgttcgttcaccgacgaggcgaatacggcgagcagcacaatcacgcccattacccagatcaccgccacgaaaatcttgaggtaggtgacaagcgcggtcagcgaagttctggtgttggcggtgatgccgccggggtatacgtaccccaaatcggcgaatcgggaatcaagacgcttgatgttctcagctacggtctgcgcttcgtacccctgctgcgtcttaatcatcacggtggagacggctttgccggcatattcggcggacatgacctgcttggagaccttggccgaggcggcgaccatgtcgggcacggtgttttggttgatgaacaccgagttgtcgaggctggtgccggtgttggcgagctgggcgacgaccggccatgaacggccgtagagttcgatggtgccgtcggtggacacgttgacgtttgcgcctgcaatcatctgaccgtcttcaagggggccttcgaactgggaggcgacccatggttcgatgacgaagtcagtgtccgggtcgtaaccgatgatctgcagcttttcggcacagcaggcggcggccagcgatgatatataggtctgttcggtggcctgtgcgatgccgtcggcctgcatgacctcgtcggcgatgtctttggtgaaatagaaagtgctgggattgccgttggtgagcagcgcttcggccttctgcacggtgttttgcggcacgaccatgaggtcggcgcccaggcgcttttccatactggtcatgccagtgttgaggttcatggtcagcatggtgccgccgaagaatgtcagcgcgaggatggtgacgacggcgagcagtgcgccggtgcggaacggcttgcgtttgaggttttcaatcggaaggccgcgcaatgcgatatgggatggcacgatgaatccttatgttgcttatagtgcggttgcaataagcgaggccggagtccagcgttcggaatggctgggctccggccgtctgctcgatcagttgcgcttggcggcgcgagagtcgagccagatggcgatggccgcgaacacgatggtgagcacgccgagcacgatgagcgtgggcagcataaccatgcgacagtgcatcatcgcgcccttgcagatgccgatcagaaaggtgggtacggcgagtagtagcagggcgtcggctgcggcggcgatattgaggccgatgcgaatctgcggggcgacgaacaaagccacgacgccgaacacgaggatgacgacgccgatgccggtggccgcctgctgcgagtagtggcaggcacccggcatgtcatggccggtgcaggcgtgcgcaaaggtctggggcgcgatggtgatcagcgcgccgaacagaatattgggcacggatgcaaacagcttgttcttcataactactttttcctctcccctgttcccagggctcgtaggcacaacctccgcattatgcccacactgtgatgaagaacacaagtcttgttttttgcgaatttatttggtatataactcagcccctcgtcagaggggccaatttatctacaacttctcaatcggcgctacgcggagcatgaggcgtttgacgccggcggagccgaagtccacggtgattaccgaattgcggcccttgtcttgtgcgtcggtgaccttgccgagaccgtactggtcgtggctgatcatgtcgcccacggcgaagtcggcgatattcaggccattgtccttggtgagcttcgagctaggcacggcagagccggtcgaatcggatttcggtgcggtacggcgcgtggtgaccttgccgccacgggtgccaccatatgaaccggacgaagaaccggaacgggaacgcgacccgtaggacgacctcgaaccggagcctgaagaaccataggacgaacccgaacgggagcgggaaccataggaggacgagccggagcgggaaccatacgacgatgaacgggaaccatacgacgaagagccggaacccgagccatacgacgacccataccgcgaccgcgacccataggacgaacccgaaccggacgaaccacgcgagccgaacgtcgacgacccgccaaacgcggcgccgccgaaatcgtcatcatcccagccgcccaaatcgtcggcgaatccatcggtctcccagctggcgcgcatacgctccacgccggcttcacggcgtttccaatcaatcagcgaatccggaatctcgtcgaggaactggctgggcatcatatcggcggcctggccccactgggagcggacggcggcgcgcgtgacatacagtcgctgcttggcgcgcgtgatgcccacataggcgagtcggcgttcctcctgcagttcagtggtgtcttccatcgaacgcgaatgcgggaaggtgccctgttccatgccggtcaggaacaccaccgggtattcgaggcccttggcggtgtgcaaggtcataagcgtcaccttgccggagtcctccgcctcgccgggtagttggtcggagtcggccacaagcgcggtggtctccaggaatgcggacaacgtggcgtcaggcgtgttctgttcgaattcggcggcagtggactgcagctgggagaggttctccagacgggaggcgtcctgcgggtccacggatttctcgagttcggcccttaagcccgacttctccaatacttcggccacgatctcgctgggcttggagtcgtgcgcgcgcgtgaactgcgagagcgcgcccatcagatcgcggaatgctcgtagcgaggtggcggtgcgtgtcggcacctcgatctcatccaagtgcatgagtgcgtagaagaagctggtgccatgctcgcgcgcgtaggcgagcagcacgccttcggcgcggtcgccaagcccacgcttgggcacgttgagaatacggcgtagattcacatcgtcgtccggattgacgagcgcctgcaaataggccagcgcatccttgatttcgcgacgttcgtagaacttggtgccgccgacgagctgatacggctgattcgtgttgatcagcgcctcttcgagcgagcgggattgggcgttggcgcggtacatgatcgccatgtcggagtaggcgatgcccgcttcggcgtgcaggcgcgcgatttcggtggccacccactgggcctcctgctgggcgttgtccgccgcgtagccgacgatcggctcgcccttgccgagcgcggtccacagtttcttgggcttgcggccctcgttgttgctgatcaccgcgttggccgcatccagaatggtctgcgtcgaacgatagttctgttcgagcatgatggtcttggcgttcgggaagtcctgctcgaagtcctgaatgttgcggatgtcggcaccacggaacgcgtagatggactggtcggaatcgcccaccacggtgatccaggcggggccggacttgccggcgttaggcgcgcccgggatggccttctcccccgtgtccacgccggccagctcgcgcacgagcacgtactgggcgtggttggtgtcctgatactcgtcgaccagaatgtaacggaagcggtgatggtagtactcggcgacggccgggtcagtgcgcagcaactcgaccgtgcggccgatcagatcgtcgaagtcgacggcgttggccagggccaagcgatgctcgtattcggcgtagatcaccgcgtagatggcttcaaggtcgcccaccgtgccgaactggtagccgcgctggccgggcgtgaagtcgggcgcgtgaacggcgaggttttccttccaaccggtcagattgttcttgaggtcggagatatggccgagaatcgagcgtggagtgtagcgcttgatgtcgaggttgaattcggtggcgatgattttgacgagtcgctcggagtcggcggaatcgtagatggagaagccggacttgagtccgatggacttgccgtcgcgcctcagaatgcgcacgcaggcggagtggaaggtggagacccacatgcgctgggccaccgggccgatcagcgagccgagtctttcgcgcatttcggcggcggccttgttggtgaaggtgatggctagaatctggctcggccatgcgccgaactggctcaagatccaggcgatgcggcaggtcagcacgcgggttttgccggagcctgcaccggctccgatcagcagcgcctgaccgcggtattgcacggcttccgcctgctgcgggttcaggtcgcccacgagttcctgtgcgctgcgtgcgatgacttccggctcgtcgtacactgttgcctccctttgaatcgcgacattcatgtttaccacatgcacgggtcagcgcaggacaacgtacacttacgagtatccatatcattcactgacatacaacaatgggaggttcaatgcaggaacttgaggagcgaatccaaagcgagggaacggtgaaggcgggtaatgtgctcaaggtggacgcgtttctgaaccaccagtgcgacgtacgcctgttcgaccgcatgggttcggcatgggccgctcatttcgccggcaagcacatcaccaagattctgaccatcgaggcgtccggcatcggcattgcgtgtgtggcggcccagcatttcggcaatgtgccggtggtgttcgccaagaagacgcagtccatcaaccttgacggcgaccagtacaccaccacggtctattccttcaccaagcagaaggagttcccggtgatcgtggccaagaagtatctgaacgccggcgaccatgtgctgcttattgacgattttctggccaacggcaaggcgttgcgcggtctgatcgatctgtgcgaagcagccggtgccacggtcgagggcattggcatcgccgtggagaagggcttccagggcggcggtgacgcgctgcgcgctgaaggctacgatgtggattcgctggccatcgtcgagtccatgaatcccgagaccggcgaaatcacatttaggcactgagcacattggctgctcccgccggcgggagcaacagagagaagaagagaatcatgtcagagaagaaaaccaatcattccgtatcctttgaggcgttgtcttcgctggacgcgccagtatccttctggaagggcattccgttcggcctgcagcatgtgatggccatgttcgtggcgaacctcgccccgatcttcatcgtcgcctcggccgcgaagatgaccccggcccaatcggccaccatcatccagtccggcctgctggttgcgggcctgggcacttgcctgcaactgtacggcgcgtggctcatcggctcgcgacttccgatggtcaccggcatctccttcacctacgtggcggccgccgtggcgatctgcgcggacaagggctatggcgcggtggtcggcgcggtaatggtcggcggtctgctggaacttgtgctgggtttgacggccaagtattggcgtcggttcgtgccgcccatcgtctccgccatcgtggtcacgtcgatcggcttctcgctgctcaacgtgggtgccacgagcttcggcggcggcagcggagccaaggacttcggttcctggcagaacctgacgctcgggcttatatctttggttgcctgcctggcgttccagctgttgatgaagggcacggccaagcagctgtccgtgctgttcggtctggtggtcggctatgtggcggctatctgcatgggcaaggtcgatttctccggtttccagaacctcgccatcgtgtccgtgccgcagttcatgccgttcaagcctgagttcgactggggctcgatcatctccatcggcctgctctacgtcgtctcctcggtcgaggtgctgggtgacaccgccgcgctgaccaaggtgggcctgaaccgtacgcccaccgaacgcgagaccgcgggcgccatcgccggcgacggcctgatctccaccgtatccggcctgttcggctgtctgccgctgacctcgttcgcacagaacatcggattggtggccatgaccaaggtcgtcaaccgcaaggtgattctctccggcggactgattctggtgctggcgagcttcgtgccggccatcgccgaggtgttcaactcgctgccgcaggcggtgctcggcggctgcacgatcatgatgttcggcaacatcattctttcgggcttccagatgattgccgaggcgggcttcacgcagcgcaacatcacgattgcggcgctttcgctgaccatcggcatcggcttcacccaggtgagcgacatcttcacgcagttcccggcactgttccaacaaatcttcgcctcgaactgcatcgccgtggcgttcgtggtggccgtgatcctgaacaccgtgctgcccagcgaggagcacttcctctctgcgcccaaggaggcaccggccgcggacgccgagtgataacaacgcaacatatcagctgcgcataatcacatgatgatgccctatcgtcttgcaggatgatagggcatcattgattttgggagagactacaagttgaaccatgagttcgagccggtggcgtgtcgatcaatcgtcatcttcccattcgaggatgtctccgggttggcagtcgagtgccttgcagatggcgtccaacgtggtgaagcggacggctttggcacgtccgttcttcagaatggacacgttggcgggagtgatgccaatttgttcggcgagctcgccgacgccaatcttgcgtttggccatcatgacgtcgagattgatgcgaatcgtcatctcaaatcacctgctcgagttcgcgcccgagccggacaaggagaacagtttccatacggccacgaacgccgcttcgatgcagaacaggaacagcacgcccataatgagatatggccagcgcatcgacgtctggctcgggtagaggccggccagcgcgccgctcaatcccggtacggcgaatagttggccccataggcaggccagccagaccagaatcacgatggctttcaacgcgagcaacacccatcggttcatgtagtttttcatagcccggtcctttcaggtgccgacgttttttttggcgacaccgcgaacatcgatatgactatatcgaaaaacgatataccttgcaaggcgtattgcgtcaaccggcattggtcgctcgtatacatataggcttcggcagactgtcagcagaccgtcagctcaacggagcgaacgccatatgagccacccattcgcgcacgagcgtgatgacggcttcgggttggtcgatgtgcgcgttgtgaccggcattgtccagcgtcacgaaggtggcgttgggatagtgcggcaacagggcttgctgatcttcgtatccgacgatctggtcttgcttgccggtgacgatgagcaccggacccgcatatgtgccgagcatttcctcgggattatcggccagccaatagcgctgatccagtcgttcgcatgccgcacggtcgcacaacgccacgccgggcaggatgaaccgttggtagcgtcgccacgcgtcgaatgactggttgacgcccatggtaatgaaatcgaacacctgttcctgcggcaaggagtgcgtcagcttgggattgggctgtgcaaccacatgttcggccacatgccggccggcatgctgcgggtccacgaccggcgcgatcaatgccataccggccactcggcgaggttcgcgcgccaatacttcgcggacaagcgcaccgcccatcgagttgccgaccatggcgaatggagccgctttaccgacaagaccgtcaatggccgtttgcagccaatccgccatttccggcagcccgcaggcatgctcgggcaatgccggcgtacggccgaaaccgggcagatccagatatatacggcgaattgaatcattgccgtcaaacgccttgtcgagcatcatcagcgaacgatggtccacacccatgccatgcacgaacacgacgggcaatccatcatcattgccctcaatcgcgcagtacggctgcaattgcgccatgtgttcctctccttcaacccggtacaaatcgcctttcacacaatagcggcagcagctcccttggtgtcggagcaatcccgaccgccattctcggtttcgaggggctgatttgcgcggatgtcatgaagcgtgaagacttgtcacaaagtcgcgtgatgacgcagccgccgttcaggtggatatgccacgctgtcatgatgacggccgagccggaacacggcaaatcccgcatgctgcataggccagccggtcacggtcagccatgacaccgaaatattggaggcgcaatgggacaacaggtgcggtacggcagacgccgctcccatggcgcgggcgcgctgattgcagccgtcatacttgttgttgcggcgctgatcgcggcatggacgctgctgccacggctattcacgcctcgcgagaccgcgcgcacggccgaggaagcatattgcgcggcggtgtcgtccgacggagcccgccgcaccttgacgcctgatcaggcgcagaacgcggcgctgattgcgaacatcgccgtcacgcgcggactgccggatcacgcggcgacggtggccatcgccacggccatgcaggagtcgaggctgacgaatctggactacggcgacttggattcgctcggcctgttccaacagcggcccagccaaggctggggcacggcggagcaggtgtccgacatgacctatgcgacaaacatcttctacgatcatctgctgcaggtgccggattgggagacgattccggtggaggacgccgcgcaggaggtgcagcgctcaggctacccggaactatatgccgcatgggatgcgatggcacgcgcttgggcctcggggctgaccggtgaacggtcggcgggcgtcacgtgcgcgttggagccagcaacctcctcggacgcggacgggttggttgccgccataggaggtacactgccgaatgtcaatgtctcggttgtgcccccaaatggcaaaaccggcacgaacaacggcgctgcgaccaatacggccagcacaacgttgacgatcacgctgccggacggcctgtccgccgacaaccgcactcgactttgctggcagacggcaggctggctggtcacgcatgcacgtcaatacggcattgacgcactgcacgcggacggcatggattggaaccgcaaagccggcacatggatcggcaccgaaaccgccgagcagaccatcaccttcacgcttgcgtgatgtgacctataccgccgttgcgaccacaaatccgactggttggagcctacgccgtcgatgccgcctgaggcacgatacggatatgtttttactcgttcgaatgagcccaatccacgacggcttcgatgttattgccatccgggtccagcacgaatgcggagtaatagccgggatggtacgggcgcggaccgggagcgccgttgtctcggccgccggcggcgagcgcggctgcatggaacgcctgcacggcttgctgactgtcagccaagaacgcgatgtgtgtgaccggcgtgaccggcgaagcctccgcctccagcccttcaatcggtgacacgtagaaatcggagtgcagggttccgtcatccacgccgaatccgagcgtaggctcatgatgcgccttgacgatatagccgagcggtgcgagcgcctgtttgtagaatgtgatgctacggtcgatgtctttcacgtgcaacgtcagatggtccagcatggtcttggtcgccctcccctggttcttgtattcgattgctgcttgcagtgtaagcccgaacgtttcccacagggccgcgcatggctatgatgagagcaatcgcacgtcgagttcgagacaatattcaaaacgaatccaaggcaataaggggaatgacgatgaccaaggcactgattgtggtggatgtgcagccgacgttctgtgaaagcggcgaactgggtgtcgcaggcggcaacgcggtcgccgagcggattgccgattatgtgaacgcgcatcgcagcgagtacgcgtatatcgcaaccacgcaggactggcatatcgagccgggcgcgcactggtcggcggagccggatttcgtggacacgtggccgaagcatggtgcggccggcacgctgaacgccgaattgcatccggcgatcaaggcgctgaatatcgagcatcatttcaagaagggccagtattcggcggcatattccggttttgagggtatcgaggacaataccgaccgtatccagacccgcgaggaggtcgaggccgagcaatccgccggcaagacgctggccaacgcgctgaaggccgccggcgtgagtcgcgtggatgtggtgggcatcgccgaatcgcattgtgtcaaggacaccgcgctcgatgccaagaagctcggcttcgaggtcaccgtgttcgaggatctgaccgtgccggtcagcgaggaacttggtgttgcggcccgcaagcagatggctgcgggcggcatcacattggctgagtcccgctgatcgggccggatatacccagagcgaagcacacagccgtagcatcaatcacgcgcaagattcccacgccacccaacatagcccgcccgcctcgaccggccgatatcatcggcgaacacgcggaaccgaaccctacatcgacgttcgtttcgtctggtttggcccatgaattctgcatgaattggggtgaactggcggggctggaggcgagcgggcggcggattatggggcacaatggtttcaaggaggccgccatggtcgatgactatactgccaaaatgactgagctgatcgaactcatgcgtctgatcggcaacgatacgcaacagtgcgaggtcaaggaatgcaagcgcaagatctcctcgaccatcaccgatacgctgtccgcgttctccaatggctccggcggctggattatcctgggcctgtccgaaaagaacgggttcacgccggtcgagggattcgacgcgcgcgccatgcaggaggcgctgagccaggcgtgcgagaagatgacgccggtggtgcggcccgtaatcgtcacctgcccgttcgaaggcgcgaatctggtgttcgcgcgcatcgacgagatgctgccgcgcgacaagccctgcttcaccaccgcgctcggaccgcacggcggctcgttcatccgtaccggcgacggcgaccggcgcatgacctcctatgaggtcgaccggctcatcgaggagcatctgcagcccacatacgatctggatatcgtgcccgacgccacgaccgatgacctcgacccgcagcttgttgccggactgttggcacgcgtgcgcgaacagcatccgcgcgtgttcgccgaccgagacggcatcgatgtgctgctggatctgcaggtgttgcgccatgatgattccgacgagtcggaggtcggcggaatcctgcgccccaccttggccggactgctggcgttgggccgctatccgcagaagttctatccgcggctcggcatttcgattgccgtgtttccggggacgagccgggacgatgtgttccggggtgacgaacgattggtcgcctcgaagtcggtggtcggttcgattccggtgatgatcgacgatgcggtcgactcgttgatgcgttggattggcgcgaaaaagcccgactatccgccgctcgtgttgcgcgaggcgattgcgaacgcgctcacccaccgtgattattcgcccgatgcgcgcggcacgcaggtgcatatcagcgtgttcaccgatcgcatcgagatcaccaatccgggtggcctgtacggcatggtgacacatgatgtgctggcgagccctcatccggtgacgggcgcgccgttcgtctccacccgaaaccagttcctgttcacgctgctggagtccacgccgtatccgggcggcgggtttgtgaacccggaaggcggcgacggctaccagcgcatcgccgccgcgttgcgcgaggccggcatcgagccggcgaccacgcgcaacgacatcaacacgttcacgatgaccatcaccaagcagcgcacgatggcgaacagttcaccgggcgacgtggtcaaggcgattatgaccgtactggagcggcattcggccatgagcgtcaaggagatcatgcgcgaactacagttgacgccgctggccgccacatccggtatgcgcgagctgatgaaggaagggcgggtcgcccgagtcaagttcgccgacgacccggcacagcggtatcggttgaaaggctgatttctcactcggccagctgcgtggtggcgggcgcggccagggcggggcgggatcggcggaagcggccggcggccaggccgatgcagatgaacatcacaccgaacagtgcgaccaatcccagcgagccggaccagccggcgacgcttatgccggtttccgccgccgtgccgaagccgagcgcgttgtcgatcgcggtgcaataccaccagccgggcaggaacttggctatggtcaccatcacgccgggcatcatgtcaatcggcaatgcgacacccgacgtgaacatgatgagcaggccgaagatgttggcgaacccgttggccgcctcttccgagagcccgaactcgctgagcatgaatccgcaggcgacggtcatcagcgcgtacacgcaggtcgcgccgaacgtcatcagcactcccccgacgctcaggtgcaacggatcgagccccgccgccatcatcagaccgattgacagcaccaaatagccgacgcatacgacgagcgcgaatccgcccaacgtcagcaaccgctggagtcccatcaggaccatgcgtcggggcgaggcggtgagacgccgccgcacctcgccggtggtgaacgtgcccaggatcatcgatccgcagatggtcatcgccagggacagcgggtacagcgcggttttcatggtgccgccgaatccgctgaccgccgtatccgcagcgcttgccgactcctcggtcggcgtatcgaccacggcgatctgatggttcacgtctgtatcgctggccgattcggcggccattttggcggcctgggacagatccttgatatccggcttgtcgacttgcccttccggcagcgagtccagcatgtcttggtccagactcgcgccatcaaaaccggcggcccctcctgtagcgttcatcatgccggcgagcgccgcctggtcgaccctcgtctgcgcgccgatcagtgcggtgcgggtgagcgagaggaacccgccgacgttcatccgcgccatcgacccggagccggatgcgtagctggtaaccgtgtccacgttcggcggattgtcgccgtccgccgccgcggcgacataatcgtcagcgaatccgtcgggaatgatgacgatcaggtccacccagttcgaggcgacggcctgttgcagcgtttcgctggtgtcgtcgaggtccaccagttcgctggaatcgcgcaggtaggcgcgcatcgacgtggcgatatcaccccggtcggagtcgcggtcgatgatggcgacgcgcgtcttggtcgattcgaacaccgcggacatggagccggatgcggaggtcagcatcgcccagctgatggacatcatcaggatgcctatgaatacgaggtagatcatcaggtagacccggtgcgcgaacagcacgcgcagcgtggctttacaggtgttcataacgttgcctcctcagcattgcgatgccggccaagaggaataccgcgctcatcgccagcagaatgatgcaggtggtgatgaacggccggtagctgtcgtagtacaggatgtcgtagaacaggttcgtcacctgctgtgcggggttgatggtgccgagtatgggcgcgttgcgggctatccagtcgctgatctgcatggcaaacccgccgtacagtccggtgaacagcgacagcgtgcaggagatgccggtcgacagcccgtatttcgtgttgtacgagagcttcggcaccgcaccgagcagggtgcctgctgagctggtcatgaacgaggcgatgatgaccgcaaggatcgccgccggttcgcgtccgccgagcgagacgttgcaggcgagccggatataggccaatgcgatggacagggcgaccgacgagcacagccagcaggagaggaagcccgcgacgagctgtttggcccggctcagcggcgctacggtccgccgtatgcccagcgcggacaggttcgcctgtgcggcggcgactgtgctgatggagtatcccatggccatcatgcaggacatggccagcagcgcgtaatagtatcgggcgatctcgtcaggctggaaatgcgtgagcgtcgtctcatgggtcatgtcgacgttctgcccgacgctgttccagaagttccggctgagcgcggcctgtggattgtcggcgatggtctgccgggtaacggcgtcggtgcggttgtacaggtcgatgacgctgcgcagggccgcgaggctaatgtccagtccgctgttttgcgtggagtccttggctgtgacggcggtttcccggctcacggtcatcgccaatcggccgttattgtcggcggtcagatagccgttggcagtgccgtcggcgagccgttgttcggcctccttcacggtgtcgactgtggtgatggtcagcagcttttggtcgatttcggcgtaggtcgtgtcgtctgaggccgattccgtttccccggccagcgcgtctacgaaggtgcgggcaccgtccgcctgctgccaacgggtgtcttcgatgacggccatcggcaccggcttgagttcgtatgcttcggccagcccgccgaacagtccgttgaacatggtcgccagcacaatcgggaacacggtcatccagaacaacgccgaccggttacgcaagttcgctttcaatgcgaccagaaatgtggtccacatgatgtctccttactcaggaactcccctcagtcacctttggtgacagctcccctcggagaggggagccaagttatttgcttgccgactgaggggagcatggtcagtccctcagtgctttgccggtgagttcgaggaacacgtcgttgagggtgggcgggcgactggtcaggtggccgatgttggcgccggagcgtttcaccgcgtcgagcacgtcggtcaggttgtgttcgccgcgacggcatcgcacgtcgagttccttgccgtcgtaggtggcttcgatcacgcacggcagcgcacggacctcggccatcgccgaatccgccagatcgagcgtttcgatggtgatgcgctcgcccgtgtcgatcatgttcttgagctcgtcggcggttccgagcgccaggtgccggccgtggtccatgatgaggatgcggtcgcagatctgttcgacctcctccatgtagtggctggtgtagatcaccgtggcgccggcctggttgagccgctggatgtcttccagaatcgaattgcggctttgcgggtcgacggcgaccgtgggttcgtcgaagaagatcaggttaggcttgtgcgcgatgccgcaggcgatgttcaggcgtcgcagcagaccgccggacagtttgccgggccggaacttgcggaagtcctggagtccgacgaattcgatggactcctcgaccagcggcgcgcggtcggttttcttcggcacgtacagcgagcagaagtagtcgatgttttcggtgacggtcagttcgttgaacacggccacgttctgcggcacgatgccgatacgacgtttcagcgcgtaggaggtcggcgtcatcggctggccgaacacgcgaatcgtgcccgaatcgtaggtgagcagcgcgaggatgcagttgatcgcggtggttttgccggacccgttcggtccaagcagcccgaaaatctcgccctggttcacgtcaaggtcaaaatagtcgagcgccaccatgtcgccgtagcgtttgaccagttggctgacgtgcacggccagagccgggttggttgtcgagtcgtgttcggaagctctgttgtcggttgtcatagtcactcccttccttggcgattccatcatcccaagaaggggccggacgccgccacaggcaaacgtcacgacttggccgtacaggcgtgacatttgtcattacagtccttcggcgtcggtctgcatggccttgtacaccttatcgaccggcatcaggctgatctcgtccatcgaatagttggacgccctgtggctttgcgtaatcatcggtatcatccctttacggttgtgtcgacgacatccgacgcttgtgcctcatctattcgggaagtgtaagcccgttgtcttggaccgtcatgcgggtaattccgcacgcccgtcaagttcgtcgtgttccgcacaccgctagactggtggtggaagagcgtcgagccggggaggtgccatgcgcgtgttggccgagatgggcttgctactcgtgttgggcctggttgtcgggctacggtccgatggcgtgttcatcgccggcctgctgttggccgtttccgtcgccggattggtggaatggctgcgtcccgcgcaatggtcttgggtcttgtgtacggcgtatctcgtcatcgccgtggcggtgccttcatggtgcgcgttcatgccgctcatcgcctacgatactgcacggctgccggccctcgcctcgaccggagcccgggctggggcacggactgcggcaagtggccgctcccccagtgtctcgcggaccgcggcctctcgccgttcccttgccgatgcaatgcgttcggccccgtggctttcggccgccgcgcgctggatatgggtgttgccgctgatcgcgctctggttcgcccgtggcaccgaccgtctccagacgctggtgatgacgctggtcgccctgcttggattcgttctgggccgggcccgcgcctcctcggacgaggcgcggcgcgcgttgctgcacgcgcaggacagggcgcgcgaatcctcgcgggccactcgttcgcgcatcgccgacatcgatgaggaacgcgcccagtcgattcgcatggcgaccctcggcgagcgcacgcgtatcgcccgggagatccacgacaatgtgggccatctgctgacccgcgcgatcatgcaggcgcaggccggcaaaacggtggccaaggcgacgaacgatacggtcgctgcgcaagggttcgccacgttgggtgcgacgttggatgatgcgatgacgatggtgcgccgttcggtgcatgatcttgaggatgatggcactgatttcgccgcgcagatcgatgatgccgtcacgtcgttcgacggcatctcccccggtttcgccgtgacgctggccaacgatatcgccaaggcgcctgcgccggtctcgcgctgtttcgcgaccgtgattcgcgaggcattgtcgaacgtggtgcatcacagcgcggcgcgcgaggcgagcgtgacgttgcgtgacttccccgcgttctggcagttggtcattcaggatccggggccggccgtgtccgagtccgatgggtcccggacggccgctgcccgcccgcgtgcgatgcgcgccacgcacgtcggctcgcgactcgccgccgacggcgttgccgatatgcgtggttcggccgatgagctgatgcgcggcatgggtttggcggatatcgaatcgcgcgtgcgcgcccttggcggcaccgcggtctgcgggccgtatgaggacggctggcgtgtgttcgtatccgtgccgaagaagcgttggaccatggaatcgagggattgatgagaatcgcaatcgtggatgatgatccgatcgtctgccagtcgttggagacgattctgacggccaccggcacggccgaggtgctatggatggcaaatgacggagacgccgccgtgcgccgttatttcgagacaccggcgagccgaccggacgtgctgctgatcgatattcagatgcccggcaccagcggtttggatgccgcgcgcgagattctggccacggacccggccgcgcgcatactgttcctgaccacgtttgcggaccagtcgtatatcgcgcaggcgatgggacttggcgccaagggctatctcatcaaacaggatgtggcggcggtcgggcccgcgctgcaggcggtgatggccggtcaggtggtgctcggcgcggaagtgctcggcaagctcaccgaacgaactccggatcctgccgattccgacgattccagagataccgccgattccatcgagggcctgcttggcgagcgcgaacgtgagatcaccgcgctggtcgccgagggcctcgataaccgcgacatcgccgccagactgttcctgagcgaaggcacggtccgcaatcgcatcagcgcgatactggacaagctcggcctgaccaatcgcacccaactcgccatcctctggctcaacgcccataggtgagggggcttttggtcaagtaggcctctccctccgacatcgcttcgcgatgccacctcgaacgcgattcaggacagcttgcagctgacctcttattcgctcgttgtcactcaccctcgcctaaaaacgcctccggcgttttcttcacggctcggctcatcagagggaggttgtgaaaaaccaacctcagctgtttttcatgacgatactgtcgatggtgttggccacgcgctcgcagtcgtcggagcactgttcgaggtgacggtagacgtcatgccaggcgaacacctgcagcggatcggtgcaggtggtgtgcagcgtgcgcatcgactcgatgaacaggtggtcggcgtccgtttcgatcgtgttgatggcgaacaccagttcgcgcaacgtcttggaatgccggaatcgcggcagttcgttgaccagctcgcagatgctttccgtggcgcgcaccaccatatccgacatctggaccgcgtcgtcgcgcatgtcggtcacgttgtcgtagtacatgcggttgagcacgccttcgatgctgtcggtcacgtcgtcgagcacgtggccgagctcgtcgatgtcctcgcggtcgaacggcgtgatgaacgcggtcaccagttcgtccatcatgtcgtggcgcacctcgtccgctgacttctcaatcgcgtgcatgctgtccatgcgttcgcgcagctggcccggattgaagtcgtgcatgacctcggacagcagcttcgcggcctggcatgcgtagtccgcgctgcggcggaatccgtcgaagtagaacgtgtctttttgtctcgccatgatgggtggattcctttctagaacacgaccatgaacagtttggccattacgaagctgatgagaccgcaaccagggaaggtgaacacccaggtgagcatcatgtcgcgcaccacgccgaagttgatggcggagaggcggcgtaccgcgcccacgcccatgatggcgctggtcttggtgtgcgtggtggagacggggatgccgagcacggtcatgacgagcaggcacagcgcgcttgacagatcggccgagaagccttggtatttctcgagtttcaccatgtcctggcccacggatttgatgatgcgttcaccgccgacggacgtgcccacgcccatgatggtgctgcacagaatcatgagccagatcggaatcatcacaccggtcacgctgggttggccattgcagaacgccatgccgaggaacagcacgccgatgaacttctggccgtcctgcgcgccgtgcatgaagctcatggccgccgcgcccacgatctgagcgtaggtgaagaacccgttggtgcggcggcggtccatgccagcgcaaatcagggtcacggccttgcataccaaccagccgacggcgaagccgaacaggaggcttgcgaccagaccgtagagcaccttgacccattctcccatgttgatgccgccgatgccgccttggatggcgatggccgctccggacaggccggcgatcaggctgtggctttcggaggtgggtatgccgagcagcgaggcgcccacgctgtatacgacgatggagaacagcgccgcgcatagggcgatgagcgccgcgttcgtgtcgccgccgaaatcgaccatgttgctgatggtggaggccacggaggcgttgagctgcgtcatgatgaagacgccgaggaagttgaagatggccgccatgatgacggcggagcgtacgcgcatgcatcgtgtggtcacgcaggtggcgatggcgttgggtgcgtcggtccagccgttgacgaagatgactcccagcgtcagcaacgttgtgacggtcagagccgggttggaaagcacttgttggaggaaatgcgccagtgagacgtccaaggggaattaacaccttcttcttcgggggcggaagccgtcacactgattgtaacggaagaatggctacgtagttcccatggcgcgcgggttttatggtgttgttatgctattgcggcctgtcagcagcaacaactggtattggggtggagacggtcgtattcctcgcgggcgcgaatgaattcgacctcgctcatcggtgtttcgccgggatgctcggccgcgaaatgctcaagataatggtcgtagcgggcctcgccgctgatctcacgcagataccagacgatgccgtgccatacggcaacgagtttgccgagcattttgtctcctttcgctgattattggctccccttgaaaaaaggggagccaatgacgcactacgctgcaacctgcccgttccgcacaagctcatgcagcttggcgctgtattcgcgctgcaccttcttctcaagcgcggtggcgaccaggctggagggcgcgaaccactgggattccacgaacggctcctcggacgtcgtttcggcaccgtacttgccagcggcgaacgtgcgcgccacgaccacgatgccgactaccacgaagacgcccatcatgaccaggaagaacacggagagcacgccgtccagatacgcgttggacagcgcggccttggcgttggtcagcgcctcgccggtcagctcgccggagtcgatctgcgcctgatacttggaggcggtggtgaagtagctcagcggcccgaagatcttctggaagtcggcggtgaaggtcacggcgatgtcccacacgagcggtaccaccggtatccacaggtgcttccagtagcccatcttggccacacacacggtgatcagcacgaagcaggcggcggcgagcagctggttggagatgccgaagataggcaccatcgcgttgatgccgccgttcgcgtcggacacgcccatccacagcagtccgccccacagcgcggtggcgatcagcgtggtgatgatgttgccgggcttccaggtcgggtcggcgaacttcttgagcttgcgcacgttgccgagcatttcgccgatctggtagcgggccacgcgggtgccgttgtccacggtggtcaggatgaacagggcttcgaacatgatggcgaagtggtaccagaaggccatcgagtcgtggccgcccaggtaggacttgaggaagttggccatgcccatggcgaacgtggtggcgccaccggtgcgggagacgatggaggtctcgccgatgtcggcggcggcctgctcaagcgccgcggcgccttcgtaggtcttggccgcgccgttctcgtccacggaatcccaggtgacctgcatctggttgccttcgatgtcggagaccttcatcgactccacggccttgacggcggcatcggcctgttcgcccggcgtggaggtggcggagatgctcacgccggatgcggcggtgatctgtgcggcggacatgttggtggagaagtacacgccctgcgagatggtgatcgcggcgatcagcgcgatgacggcggtgaacgattcgacgagcatcgaaccgtagccgatcatgcgaatctggttctccttctccacggccttcggggtcaggccggagctcaccgcgccgtggaagccggagagagcgccgcaggcgatggtgatgaacaggaacgggaataggttgccggagaaggtcgggccggtggaggtggaggccagttcggtcagacccggcaccttgacggacgggttggcgatgatgatgccgatgacgagcagcacgagcgtgccgatcttcatcagcgtggacaggtagtcgcgcggggtgacgagcagccagtgcggcagcgcggcggcggcgaacgagtagatcaccagggcgatgacgagctgcttggcgtccagtgtgaacacggcggccacggccgggatagaggcgatccatccgccggcgacgatgtcgagcacgagcagcacgaaaccgagcagcgtggtctcaatgacacggccggggcgcaggaaacgctggtagcagcccatgatcagggcgatcgggatggtcataccgatggagaacacggcccacggcgaggcggccatggccttgatggccacgagcgccaggaatgccatggcgatggcggtcatcaccacgaggaagatggataggatcataccgccgaacttacccatttcatcagtggccatctggcccagagagcgaccgcggcgcttggcggagatccacagcaccagcatgtcctgcacggcgccggcgaaaatcacgccgaggatgatccacagagtggagggcaggtagcccatctgcgcggccaggatcgggccgacgagcggtccggcgccggagatgccggcaaagtgctggccgaagagcacgcggcggtcggtgcgttcgaagttcgcgccgtcatgcacgcgctcggccggggtggcgttcgcgtcgtcggtgcgcatgatcttgatctggatgtaataggcatagaagcggtaggcgatggcgtaggagctcagcgccacgaccaggaaccagatggcggagatccgctcaccgcgcgagacggccagaatcgcccatccgcaggcacatacgatggcgatggcggcccacagcagggccttcttccatgtccataccattttgggacgcacgcctacgggcagtcccttcgaattgcgaatcacacgttcggcttcgtccggcgtgtaatcgtccttgaattccaacttgccaggtgccggggcctgggctgcggcggtggtcataataaccctctgttcctcttcaataacctttgcgggaaaggttctcttcattgcgacccttttggggtatctctcgtctgcttatggcactggttggaagcgtagccacggcatgtagcgcctcaggaaaatgtcccaatatgtgagcttggccacatgttcacggactgcgtttcatgccgattacccgggattcgcaccgcgatgtgcgaaaatggacacggtatcaatcaggaggtgcacagtggttgtaagcacggattcgagccgcacaatgcccgattgggtgaagtacggggtgttctggcacgtgtatccgctgggcttctgcggtgccgatatcaggcccgccggcccgcgccagttccatggccgcggccttgacgcgataattccctggctggagtacgtgcgcgatctaggcgcgtccggcctgctgctgggtccggtgttcgagtcggcgacgcatggatacgacacgctcgaccatatgcatatcgatgtgcgattgggcggggatgccgcgttcgatcagcttgtcgcggcctgccgggacatgggattgcaggtgatgctggatggcgtgttcaatcatgtgagccgcaatcatccggccgttcagacggcgcttgacgagaccgccggacgcttgaatccggccgacaacccgtggcatggtctggtccgcgcgcatgtcggtgataatggcgaacccgctttggatgtgttcgaggggcacggggatctggtggcgctggaccattcggctgacgagaccgttgactatgtggtccatgtgatgagccattggctggatcgcggagccgccggctggcgcctcgacgccgcgtatgccgtgccgagcccgttctgggcgctcgtgttgccgcaggtcaaagccgcacacccgtattcgtggattttcggcgaggtgatccatggcgattacccgcgcatcatcaaggaatccacgatggattcgatcacgcaatacgagctatggaagtcgatccagcatgcgctggagacggagaacttcttcgagctggattggaacttgaagcggcacaacgcgttcctggattccttcgtgccgcagacgttcatcggcaaccatgacgtgacgcgtatcgcatcgcagattggcccggccaaggcggcgttggcattggcggtgctcatgacggtcggcggcgtgccaagcatctattacggcgacgaacagggctatgtgggcgtcaagcaggagcgtttcggcggcgatgacgacgtacgtccgaagttccccggctcccctgccgaactgtccacgctgggagagccgacataccggctgcatcaggcgctgatcgcgctgcgccgtcgcaacccatggctgctggatgcgcgtaccgaggccgtgaagctggaaaacaagcacttcgtctatcgttcgacgagcgccgacgcccagcattccctgaccgtggacctcaacatcgagcaatcccccactttcaccatccgcaacgccgatggcagtacagcgtatcaatggtgagctccctcatcagagggagctaactcattcacctctgaatgcctcggatcagcaggtcgagcaggtaaccgtacgaccggtcgacccgttcgcggccgcgtgtgcggggttgtgcggaacgcagttcgaattggatgaacccgtgtatggacacccagatggaggatgcgattagatgggggtcatcgccgcggaatacagatgctgcctggccgtatcgaatgatctgcgtgatggcgtccaggcagtgctgggccgagtccgacgcctgccccatccagaccagcgcgtaaatgccgggggcgtccagcgcgtgttcacggtagattatgcccgccctgcgcaggcgtagcacggggtcggattcgtcaatggcgatgagctgttcgcgcagatcggtgaagtatgtgtcgatgagcgcatcgcacaccgcctgcttgccgccgatgtgctggtagatgctggtgggcgacacatcggcctgtgcggacagcgcacggatggtcagaccatccacaccgtcccgttccacgatccgccttgccgcgtcaaggattctcccgtggatttcaagggtgggcgtgcgtttggatcggggctgcgattgcgtcatatccgttattctagggtgcgtacaggccattaccgccgtttcggcatggccacgatcacaacgactgcggcgataagtgcaatcgtcatggccgctaggcaggcgaacaggcatccgcatcgcaaacaccggcctataacacaatcaggcccgacgaccatcaaaggtcgtcgggcctgattcatacgcgctgtcggactaacggcgtccagacttcatacggaatggcgcattgtggcgattcttcttggaatgacggcggttcgggccttccgtgttgccgtatttggcgatcatgcggcgttcgtgacgcttggcaccttctgaacgctcgtcgcgtacgatgcggttctcgttcttgcgatggatgcgcttgccgccttcgccctgacgggtgttgcgcatggactgtctgcggccgtcatgggagcgctcgtcataggagaagccgtaatcctcgtggctgcgttcattgcggcgaggcttgcgcggacgctcgaaatcgcgggaatcggaccgttcgaaatcacggcccgcattgtgcctgcggctgccgaaatcatcgttgcgaccgtatccggccctgtcgcgcttatcgaacttgtcgcccttgccgtaccgatcattgcgacggttcttgccgtgctggtcgcggccattgtcctgacgctcgtcgtaccggttcttgccgtatccgtcgcgacggtcgcccttgcggcgctcctcgcggcggtcatcgccatgctcgaacagatagtcgcggcgctcggcctcggggttgctcatgcctgcacggcgttccgcacggttgcggttcttcttcacggccttcttgctggccttgtcgccgtgcttgcgctgcggctcgccttcggcaacaaactcgccgcctgcgttctcgtgctggaactcggtctcggcaacgttctgctcgtcacggttgcgattgcgattgtgcttgcgcttgccgccgcggccggactcgtcgcccgccgcgttcttggcgcccctgttcttgcccttgcgcgggttgcccacgggctgcgacttgtcgaggctccaaccatccacgcgctcggcgcggtcgcccacaagctcaagcacttcgggcgaatcgtgggtcacttcgatcatcttggtcttgatgccggcctggttcagcaagcggcgcgtctcgcggcgctgctcgggcagcacgagggtgaccacgtcgcccgccttgccggcgcgggcggtacgaccggagcggtgcacaaaggacttcgggtcggccggcggctcgacctgcaccacgagctccacgccgccgacgtctatgccacgggcggccacgtcggtggccaccatgacacgcacatcgccggaatcgaacgcagcgaggttgcgatcgcgctggttctggttcaggttgccgtgcagctcggcggccggaatgccgttctgcgtcaggttcttggcgagcttcttggcctggaacttggtgcgggtgaacaggatgcggcggccttcgcccgaggcgagcatgcgcacgagttcgtgcttgtcgccgcgcgtggtttcgaacacgtggtgggtcatcaggtcgggttcggtggtggccgaatcgacctcgtgcaccttgggatcgtgcaggaaggtgttcaccacttcatccacgccgtgatcgagcgtggcggagaacagcatgtgctgggcgtcgggcgaaatctgctcaagcagtcgcttgaccggcggcaggaagcccatatcggccatttcgtcggcctcatcgatgaccacgacttcgacggacgagagcgtgagcgcctgctggcgcagcaggtcctcaaggcggcccgggcaggcgaccacgatatcggcgccggccttcagatcgcggatctggtggatgtacttgacgccgccgtacaccgtggtggtgttcatgccgaacgtgtgggccagcggcatcagcacgtcgttgatctggttcgcgagctcgcgggtgggggccagcaccaggccgcgcgggtgcggtaggaagtcgtcggcgcggcgctcttccaggctggccttcttgcggcgcttgatttccttgcggaactcctccatcgcgatttcgccgaacgaatcgtaggaaccgaggcgggtgaccagcggaatggagaatgcgagggttttgccggagccggtgcgacctcggccgagaatgtcgcggccggccagtgaatcgggcagggtgtcggcctgaatggggaatgcggtcttcttgtcatctgccgcaagcacgcgcaccagcggtccgggtacgccaagttcgccaaaggtaagggggcgggattccgcgctgtcgttcatctggaaatcagcggaatcgtcacgatcatcgaaattattacggggcacagtggcctttcatgtcaaaggttacgcaaattacgcaagctttccgagcttagcgtaagccccctactttgcttggtgctcgccacactgtcatcccactctttacttatgaccccatggggcggtaactcgcccatggggcggcaacttgcccatggggcggtttgaagaaattgtgaaaccgcagaataaagccattttcacctaccgccccatgagggttttaccaccccatgggatatttgccgccccatgggttttaccaccacgtaaggcgagcaccgctccatggaacacgcaaatggcccccacccgtgaaggtaggggccattgtgcaaaagggctgagccaagatacagcccagtagccctaaaacacactacaaaatatccggatcgtctttggcaatagtgccggttgccttgccaatggccttcaggccgtggtaggccacaagaatcacgatcgtgccaatggcaatgccgttgaaggaaatgccaccaacagtgaacgcgaattggccgatggcaatgatcatggtgatggctgccaccatgatattcagcggcttgtcgaagttgaccttgttctccacccagatgcggataccgatcatgccgatcatgccatacagcagcgtggtcacgccaccgagcacgccggcggggatcgtgttgatcacggcaccgaacttcgggcacaggctcaggatcagggcaaaggcggcggcgcaccagtaggcggcggtggagtacaccttggtggcggccatcacaccgatgttctcgccgtaggtggtggtgccggagccgccgccgaagccggcgagcgtggtgcccaggccgtcggccatgagggcggtgccgatctgattgtcgtagtcgcggccggtcatttgggccacggacttgacatggccaacgttctcagccacaagcacaagcacaacagggatgaacatgggaaggatggagaaatcggcctgcggcaggtggaacttcgggaagccgatccatgcggcgtcgccgatggcggagaagtcgacctgaccacggatgcaggcatatacatagccgatgatcacgccgaccaaaatattgaggcgacccagcaagcccttgaacagcacagccacgagcagcacggccaacagggtaaccagtgcggtgtcgggcgcggcttggaagttggtccacacggaaggtgccagattgaagccgatgatggccacgatcgcgccgttgaccacgggcggcatgatgatgtcgatccatttggagccggcgtaatgcacgagcacgccaaccagggccagcagaataccggtgaccatgatgccgaagctggcgaccgcaatgcccttgttggcggtggtgaccgcggtgatcggtgcaatgaagccgaaggacgagcccaaatagctcggcagcacgttcctgttgatcagcagaaacagtgcggtggacatagccgtgaagaacagggtggtggacgggtcgaagcccgtcagaatcggcaccaggaaggtggcaccgaacatggcgatgacgtgctgtgcgccgataccggcggtgcgcacccaagtcagacgttcatcgggctcgactacctcgccgggcgccagcgtcttgccgtcgccatgcaattgccattggaagatattggacattactactctcctcgctctcgcttggggcacggcattcacaaccagccgcaccacgcaccattctagctcacgaagattttgtgaagtctctcttccgggaaaggctatttgccgtaatactccagcaggtgtggatcgacggcctgcaccacatccaccaaatcgccattggagagatacgggcgcttgaattcgcgccacggctccaccttgacctcccagcggccggtcgtctcgtcgagcacgggccgggcggtctgctcccagcgcacacgcttggaggtgcggccggtttccgggtcgcggcgtgtatagtgcaggcaggtgcagttggtgatcttccagtcgtccgagtcggcgcgatgcaggaattcctcgtcggccagatcctcgatggtgagcatcagggcgagcatgaagtcgccgtgggtgaccatgaccacggattccgaatcggatttgcggctcagcgaggtcaggatgttgtgcacacggtcctcggccacatcggcaatcgactcgcctgccggcggacgccagtacagcggatcggtgttcttgaagttccagttgcgcgcgtagttgtttttgaattcgtccttggtgatggtgttgatctcaccccaagaacgttcacgcagcacacggttctcctcccatttggccttgggcagggccatggtggctgcggtttcgcgggtgcgcacgtatggcgagaccatgtagcggtcgaacagctgctgctggctgaccagccagcgaccgatgcagtcggcctgcttgcgcccggtggcggtgagtctccaggagcgatcgggcacagtgacgttgtcctgcgtgtacagggaattgtcgccctgctcgcccgcctggacgatgacgttcgcttcggattcgccatgccggattacgtatagatcgagcggcatgctcatatatgttcccctttcgttattggttacgttgtgttgttttctgttgtttcctacttgacttgcgtgatggtgttccccttgaccatgaacgcgtgccgggccatgtcgatcatcggctgatcgaatttggagtcggtgtagaactcgtcgatgacgacgtccggaccgtacagttcgcggaaccgtttggccttgttggtgctgaagttgaggtacgtgaccttcatcgtccccacatccacctcgctggccacgagattcctcacgccgagtctgcggcaggcctcccccaccgtcagatcgaaggatgcggtgaggatcacatcgtccgactcaggctggtaccaaggcttgatacgtgcgtaatatcggtcccagaaatcgtccacgagctgttcgacgctcgccacccgtttggatcggctcagttccgtgagatagccttcggtcatcttgcccacgccgtattccatctgttcaagcgtggcccggccaagcttgtatttgaccgcgtaccgcagcacgggggcgatatagcggaacactttcgggtcgtggcgggcggaatacaggtacaagtcgaacaggctttcgccatcatagatggttccgtcgaaatcgaatacgcgcataccttctgcttctactctgttattccttgtctaaggctaatctcggtaagccggcgaaagcgcaaatacgcagtgaatttcacatgaacactgttttttggattgatttcggtacaggtaacgtacactggtgacagcgtggaaggaggtgcgtaatggcgacgtctgaaatcgaacaatggtggattgataagtttcaggagaacctgggtccgattcgcaaggtagccggatggacgactcagcaactggccgacgagctgggagtcgcgcgacagacggtgtctaacttggagaccggcaaaagcccgatgaccaaactgcagtatctcgctttacgtacggtgttcagcgccgagatcgcacgtcgtgaagaccgcgatctggcacgcatcatcaagactttggtcgacgatcccattgagcaacgcattcgcgaacggcgcgcccaagagcaagacggcgaggccgttgccgacaatgccccagtcaatacaggctgtggcaacgctgccgacaacgccgccaccgagaaacgcaagcccagtgccgccacattgaaggcttcaaagactgccgcaacgggcaagcccacgctcagcacggcgatgcaggctctcgccgtcatcaccggcgcattggccagtggaaccgccgccggcatcatcacctacttgatgttcccggacggcggcccgaacaagcgctgagtcgccgaaatatcgaaacggattgaacaacccagttcgaagccctgagcaccattttgtccgtgtcgcaccagcgtttccctcattatcagctgtttcgagttgcatgaatgcaccgtttataggccgagaatttcgtgcttttttgcatcaaattcttcttgggagagaatgccgatatcaaccaattccttcaatttcttcatcgcctcgacttgttcttccacagacatggatgccgtgtgagaggcgggagcagcggcttccggtgccggcgcaggtgccggcgcttgaaccggggcggcagtcataggattgatggcttgcgccatattcataccaagcaacatgccgccatcgccaaagccgttgtcttgaataccttgcgcaatgcgctgctgggcagccatattgccagcttgttgggaaacgccctcgtatgcggcaacattcatcttattcgaggcgaactgctgcacgagctgacgtgattgctcggtgaactcgatgctttcgatgcccacgctggacacttcaaagccaaaacgatcattccatgtaccggcattggctcgatcgccacgcacgcatgctgcgatgtcattcgccttgccgggcaattgcgaaatacgatattcattggacaacgaattgatggccacaataaacgactgtacgaattcggacagaatctgcctacgtggcccttcatcatcgaatgaatacgacacggtagtggcaggcacaaagttacgaacgaatcgaactggatcagtgacctttagcgacatggatccgcgtgcgcgaatttccaaatcgacgccatagaaccggtcgttatacaccagcggcgcagaagtgccgaatttgatgccacgaatctcacgcaggttgacgaaggccacatatttggtgcggccaggctgacctccgaaggtgaatcgatcggcgacttggttgaagaacgatccgatgccgtctccggcgagcacgctctgttccccgttgcgatattcataaccgcccgactcggtgatgacgttttcgatacctgtttcagagaaaatgaacgccgcagtattctctggcacatagatacgcgaaccattggtgattattccctcggaaccgtattcattcgaaccgcgatcgttgttgcttccgcggggaatgcccggcacaacgacggtgtgttccgtgaacggaccagcggtgatgatatcacgccacaggtccgcgaatgtaccgccgagcgcgccggcgaacgccttaataactgccatctgttttcctcgatatctcaatgcacatggccggtcttgcgactatgcaatcgcaagaccggccgttatgctggcatgttggctatagctgcgtttcgcgatcgcagtattcgcatcgaacgacttctttgcgatgaccggaaagcggagcgccacaaccttcacaattcaccgaaaccacgggttcggtaatcccaagcccactacggaatgcgccaaaagtgtccttcagcgccccggccagagcctccgttccggggatggccttgttgaagaccggctcatccattggcgtatactgtctgccgcgtatacccatgtaccgtcatcgttcctttcttggaaaaccgttacctcgatacgccagtctgatcactggcccaccgatgcgagcttctgcgcgcatcgagtcatgacctcggtgtagtaggccgaatcctcactgctgagggagttttcgtcaatggcgtctaccttctgggagaactcagagtaacgcttcatcatgctggcatagtcggtagccatgctgaccacgttgtcggatttctgatatttgttcatgaaggcaacatactcatcgataaaggcctcgtagctgtccatcgtggacttgaagtcagcactgtcattggtgttctgctgcgccttctgatccgaagactggtcgctctgcttgttggcatcgctggaatcagtgcccgtatcagtgctcttatcatcctgcttcgcggcgtcgccgtccgtagacgtatcttccttcttttccggaacctggatagtgatggacatgatggtctcgtcgtcagtgtcacgagaaacgctcacactgtatccatcggcgttcttggcattgaagatgtcagcggacttgctatagtccacggtgaaaccgttgtcttgcacggacttgacgtagtcggcatactgcttggcgtcggtatcgcacacctcgatggagaagtagtccgaagactcgcttttaatttcaccctttgtggatttcggctgcggcagcagcgccgcgatatccgactccggccatgaatatgcttcgcacttggtggcgagcgatgcttccaattccgcccgatcagccttggccttcgcaccgtcacgaattacgaacacgccaccgattaccagacccacaacggtgataccgactgccacccaggccagcactcggccttgcaccttgccactcgggcgggtcacgtatacggcgaagcctgagagcagtgccggaatcaccgtggcgaacagcagtccgccccaggatcggccagaaacatccacaaattgggcgagtacgaacaacactccccaaataatggcgaacacagccagcttggaagtcttcttcaccccttgtgcattcggagcaagcacggcaggcgcagcggcaccagcaaaaccagtggcagcaccggcaccatgtgtggcgggtgcaggagccacaccaatacgcttgtccagagcggcgaggaactcatcaacgcgcttggcgctttcgtttccagtcgcctccagacgaatggcggcccctgccgcaccctgcgggactacggttagcgtgcagttcaccccatcataggagtggaaggaaaacgctccggtctgggtgttttcgttatccaaggtaaacgtggcgccagtagtcagctggtcgtgaataacttggaacagctgttgcggactgaccgcatatacacgatcaaatggcgcgccggcgggccgctgcgatgccgtagccggagtcatcggagtagtggtagcaccatcagacgctacgttcggttggccagccggtacagtattcggcacggtaggcgcattcgcgcgatcttccggtgcgtcattcgtgccttcggacggtggaaccggctgaggttgttgatcaaatggcgttgtcatgatgcccttctttccttaagcagcagcattaccagcacagaagaggcaagtccggcaaccgttacggtcaatccgactgccatggcaagccggtatcgttcgctcatcattgcgtcccttcttattgctcgctttgctctgcgatacatcgaaaccagtgtatggcgttgttattatgtacgcaaattagcattttgtatgcatgttagctttattgtcgatgcttgataccgcgcatgaacatcctttccgccaccgcacctacacggatggcatcgaccattgtcggcgacacgcgcgggccatacatcagctgacaactgaatttttcggcgtgtttccgaaaagtcggcgtcctgtacgctgggaatcgagcaaccgcgtacgctggcgcagcacagcacccgcaacacagcgacaaggagcatgggcaatggcagacatccccgaagaacatttgaccgaggaactgttggatcggctgctcgccagcgccagcattgagcagtatctcgatgagggactcgtcagcgcacgcacgctgaccgactatctgttcgaccgtatggaagcccatgacctgagacgagccgacgtggtgcgggcatccggcctcaacgccacagtggtttatgacattttctccggcaaaagccgccccggccgagatcacgccattatgctggcttttggtctcaagtgcatattacgtgaaacccaacggctacttcgtcttgcaggcgtttccgaactgtggtgcaaacagcgacgcgacgcgattatcatctggtgtatacgcaatggattcgaccgcattgccacggacgacgagttgtatcgtatgggagaggcgacgttgctaccggccgattgacgacattcggcccaacaacactcaccagtgagacgcaagtaagagggcatcaaggagagacatggacgataagcaggcgatgcatgcgatgagcatcgacgatgcgtaccatgtcgagcgtacgctcgctcgcggaccttccggcgtcaccgaactggtgagcattgacggcaacggcccgttcgtacgcaagaagattccctctcccctagcgcaacgcaatgtgtgggcggcgctcagcgcctgccagagtaatcgtctgccgcgtgtggaagcgacgtacgagctgcccgaccggttcgtcatcgtctacgattacgtgccgggcagcacgcttgcgcaaattgcggaggaaaacgggcggcttgcaccgaatgtggccgtgcagcttatcgaccaaatttgcgaagccgtgcaggagcttcaccagcacggcgttatccaccgcgacatcacgccggccaacgtcatcgtggcccaggatggcgcgcatctcatcgatttcggcatcgcgcgcatccggtcagaggcaagcaaccgttcacgggataccacggcgcttggcacctacggattcgcctcgcctgagcaatatggctttgccaaaaccgacgcgcgttccgacgtattctcgctgggccggctactcggattcatgctgaccggcgtatatcccgatgccagcgactacgagcagcgacttgccgatgatgccgcagtaccggctcgactacgcgccgtcatcggctatgcgtgcgcattcgagcccagcaaacggccacagagcgtccaagagtttcgccaggcgctgttctcccagtccaatccgcccataccgaacgcatcatcggcaaatccgccatcaacgagaacaacgaacggcagcgcgtcggcgtctcgactattccggcgtctgcacttgagcaaacgcgccatcgtgctgtggtccattgccggagcggcactgataatcgccgccattgcgggaggcattgtgttggcaggccaacttggcattatcgggtcggcaacatcacccgattcctcgacacaatccagcagccaatcaaccgataaggccgatggcgggcactcctcgaacgggtcaggaaccgacaatgccaatggcacgggcggagtagtcggcactgacggcgctgatggagacaatcaagacaccgtcaccgacaatcctctgaaaatagtggaatccggctggtcggcggaccagcaagggtatgtccactacgctttcgccctgcgcaacaccagtacgacccagcaggtgcagtatccgcagattaccattacggggcgggccaaagacggttccatcgtgttctcgcagacgcaagcactgaatatggcattcccgaatcagactgtatatgacgccggccaagcgggcgagggcacggccccggccaccgtagatttcgttgtgcttagccctgatacgtacaacgtcaccgaggctcaaggaaccgctaccttccccatcagcggaacatccaaaatagacaacagggacggcggcacgacgttcaatggcgaggtccgcgccgtggcagatggattcaagccatctgatggacagcaaatcaagatttccctagtactgcgtaacgcacagaacgcaatcatctatggagatatcgcattcgtggattggccgggcaatggccgatccacgccattctcgattaccgtctacgatctgccgaagtatgtgtcttacgatctgtatgcgcaaatctggtagttgactttacgtctggcaggtggccgtcaggtgcctgtcaggccgctgttcgcgtcacctgcgcactgacgttacggcgcgcctggccgaacagatagatgccgatgggcagggtcagaacaccgccgatgatgaacaccagcgaaatcgggatcacgtcggccagtggcgcgaagatcaacatgccgagcggcattccgagcgtgctcagggtggtgtcaaggccgaatacacggcccaccatcttctcatcggcctcggtctggatgatggtgcgcatcgggcccatgcagatggccgaagccaaaccgttcaccacatcaatcagcaaatacgccagcagattgtgaaccacgccaagaccaacgacggagacgcccaccagagcgatgccgaaggcgaccacgcgcatgttgttgcggatgagcttggcaccgatggtagacatcagcgcgccgccgagcagcataccgatgctccatcccagctcgttggcggcgagtttatcggaggcggtggtcaggttgatgaatccgagattcaaatcgatgccctcatattcgcgggtcatgagcaacagcgtaaggttcatcggcgccacggccacgaagcacaccaaggcgtcaccgagcaccacgttgcgcaggttcgcccggcgccatgtgtagctgaaaccatctttcaagtcagcaaacacacgacggacgctggcaatcagcgaacgatcagcattggcatccgacatcggttcgagtgtgggttgcccgctattctccgcttcagccatacgcctcgcaacatgttccgtgctcttcttcggcgctttgatcaacgccacaaagccgacgccgataatggccgtggtcacatcgactaacagaatcgaccacagcggcactgtgttgataagcacagcagccaccgcaggtgccacaatcatattcaccgaattaatcacgccgtatattgagttgacgcgcaatagtttgcccgagggaacaacatccggtatgaacgactgcacagcgggcgtctgcaccccgcctcccgccgaacgaatgaacagcaccacgaaaatcatggtcagactcgcccatcccatcgcgaagctcagcgacagcacgacggtgaccacagcaatcaccatatccggcagcataatcagcaacttgcgactgtgacggtcggcccaggagccgccgcaaatcgagacgatggcctgcggcaccacgccaaacaacgtggccagcagcatggccgaaccggttttagtctgcaatacgatccaccaccagatggcatattgcacaatattggagcccagcagcgagaacgcctggccggtgagtagaagcactacacggcggatccacgcacgctcggattccccgttggccactgctgcggcataggcggcaccgggtttgttcgcgctatggaccgctgcgcgcgcattcgcattgtcatcgccggaaacctcgggtgtttcgcgcacagttggttcagttgttttttgactagaagacatacgagtgttctcaattcttcaattccactacaaaggtcacatcacggcatacgcacgccgacgcgcgtatgcgtgcacgactccagcaacgagccgtacccgccgttagatggcaggcttcagtatcgtgacgccatgcgttagcgtcaccatgcaacgataggaacacactattcgatagtataatcatgaaggcgtgacgttgcccttgcgcaggtgccgtaagactccgcggacaaagcgatgaggcttcccccgcgagaagggaagcctcatattccattcattctattcagcgatgatggcgcctaatcaccgatcatcctttgggaacagcgcatcgaaggcatgttccatcacggacttacggcggatcacaccgacgagtctgccatcagcatccaccaccggcagtttcttgaactgcttcttggcgaggattcgggccacctctccgacatgctggtcgggcgtggcggcaacgaccttacgcgtggcgatgtccatcaccttcttgccggagagcgcctgcaccttggaggccacggtctcgtcgtcgaacaccaccatcgtcgaaccggtgccggtggagaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatacccacgcctcgcgggccgaatttgtcgaatgcggcgccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcacggagttgcggaagttgcgggtggcaagggtgtcaacgcgcaacaatggctcatcgagcttgacttgcttgtatacgaatgcgacgaaggccacaagaccaacgacgattgagataatgacgaccggactgctccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacgactgcgatgccaatgaacatcgggcgccatccgaaactgtcaatcaccagaccaccgacaaccgggccgatagccgggccggcggccatgacgataccggccatgcccatggcggtgccgcgcttatccggcggatagacgagcatcggcactacggcgaccaatggcagcagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgatgatgaatcgggtgtgcgaatcaataggctttacggaactggtggcggacccgagttccgcggttttctgtgaggtcacagcatttccttctgttggtaacgtcatgtgtggcgatccggccccatgcttgtgtcaagacacgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccatttgtggattggcaaacagaacattgccgacgaacgacccacggcaggcgcgtgcgatgaacatcgcgtagcgatacaggttcatggcatctccttgatgagtcttcgtacggcggacatcgagaagcctatcatcattcaaatcgacggtgaaacccacgcatgcctgacaatacacaaaatcttcacaagaggattgggcttacgcatacgctccgcctgaataacggtccggggatgaatcaggggcgagctaagggttgcgtctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccttgacgccgtttggcaaaaccgtgcaatacggcggcggagtcggctctgccttggccaacatcctgtgggtggtgctggtcggctgctggatggcgctcggctatctgggtgcaggcgtgctcaactgcatcaccatcatcggcattccgttcggcatccagtcgttcaaaatggccaagctcgcgctctggccgttcggcgcacagatctacagtctgtaacaattgtttctgcagtaggtccggtgcagcgcattatcatcgtgcgttgcaccggacttttttatatacaacaggcatttcacacaccgtgatttgacggattcggacgtaagaccttatggtgtgcacaccatgattcaacacatcgcattcagcagcaacggcgtgaacgaacacgccaagcgtcagcagatgaacctgccggcgatgctcgaatgcgccttcaaacagggtttgcgcactgctcagttccagccaataaccggaaacaagcgcagtctgctcgctgccatacaaatctgatcagtacacctctcattggcgcatagctgaatcattgccggtgatatcgagccgactcgttcgcaccatgcctcataaacgcacctgcacgagcatgcgttcttggcatagtcgcaactcaatgcaccgcagcaaaacccattgcataccatcacatattcagaaagaacaacagatcatgaagtatttcactactgacacgcatttcgggcatccgctggtcagcgtgctgcgcggattcaccacgttcgaccctgggcacacgcagtatgacgctctcctctcctcgcagggacgcaaggccgccgaggattgggcgaagggcgtggtgcttgacgattcccggctcaatttccgcaaggccgcagacaccgatgcgcacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacgatgcacccgcgcgagatctgttcgaatcgattgagccgaacagcacggcggagctgaccggtctcggaattggccgcccgcaggcaacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgggccggcgcccattgactccgccgcacagcaggaaccaggcggctcggtttcggcagccgaatcataatacaagcaatattggggcgagcagaaccttatgccatcgctggcacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcggatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcgcggacccttacgttcgggttattccggtgcgcggcgaaacagacgtgtatgcgtgcaatttcactgcagaggcatttcgtgaacatcggtggacggatcgcaccatcaatgcgcgagggctttttgtcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcctgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatctgattcgtaatgccgaatcgttctccatcgatgccgctcacgaggaaacgttcactcttgccggcggcttcgtgcggccggaaacggtggcgatctgccattcgccggaagaagtcgcccaggcaatcggcgacgccaaggcaagcccgcatgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaacgacatcgtggaccacgtgcggtgactgctgagttctagcgcaatatcttctgaccaacgtatgtatcacgaaagcatgtgtcgtgaaagcatgtattgcgctagaaccaaatcattctcgttgagggcggataatgaatctctatgctttgaacatgacgcaccatatgccggcatttccttgcgcgaacaactgttcattacgaacattgtactgatgccgttacagaacagaagagggtgctgtcctagcgacaaccatccgacccggttctgccaggcaccgaaccgattcgacaaggacgccgtgaaagacatcatgttcggttgggatgacacgaagaaggatcccaagcgcagggattcccggctgatagtcatcggcgacgaccggcagacgccgttgcagcgcggcgcgctcaccgcgttccgcaactacggtgtgaccgttatcccctactccaaattggaagagcgggctcccgtggaactcgccgcgtagcttccgagccatataaggactcatcccgacgactcaccgcgagcaccgggatgagtccttggttcttgtgtttcgctatatgatcttgtgtttcgctatatgattgagtcatgtcggacgacaatgtccggcacgaagggagacccatcatgaaaaaggcaatcgcactgcttgttgcggcgatgttgcttaccggcctgtccgcttgcgggggaagcactacggccgatgcgccggccaaatccgatggcacgtcaaagaccgagaccaataaggaagaacccaaaccccagccggccgatctgaccggcacatggaagcagaccaattccaacgacccgagctcatacatggaagctaccatcagcggcgacaccatcgaggtcaactggatcggcaccgacaccaagagcctctactggaagggcacctatcaggcaccggccgcagccggcgattggaaatggaccagccagggcgacaccgagaccatggccagcgcgctcctcgcctcgcaggatgccaccaaggacttcacctacagtgaggcggacggcgtgagctgggagaccaccgcgctcggtaccaccatcaccgtcaagacggtcaagcaataaatcccgtgtcgggcggatcaagccctaaacacgaaaccgccccggtcactctgcgagcgccggggcggccctgcgacatatcgacgattagacaatctgtcgcattttcttgactgccgcccacatgaccgtctatcatcatttatagatcagcgacaagaatacacaggtatccttcccctcgaaggatcagctggtcgtattattggattttggcctgtccttcatcgaaagtcggcttcatgccgtcgtcgtcacagcacgactagagttgagacgggccatctattccttctaccattcaggttgcgcccatccgtcgaagttgatggatgctctggtcagaggattgtatttcggccgataatagttctttgatttgaaatatctgctggaatcataaacatcatggaccagcacaatcttcggttcaagaagcccgaagaacttttcgtctcccttctcgtacactcgctggaccgtccatagactgtagtcggcgagcgccaagagaatttcgtgatcatacggttggacgttgaatttggtggtgtttcgcaattcatgcgttaccgtgccgcgacggctgcgctgttgcgcgatgtccacggcatgctgaaggttgaggttcgatgtgctgctgcctcgttccgcgacgtcgagaatcaacggatctatcttccctgagtatttgagtagatgggacatgaggtcggcgtagaattcacgtggttgttcgttgtgcctctgctgatagatcgccggtatcttacggcccacaactactcgtgcggagaagtcgatctcctgcgccatgagtttgaggaattcatagcgtagttccgcaggatctttgctggcatgcgggtagaagccgtgccatccctcctttattctcttttggacgctgggaaagctctggaagaatttgctgctgttgatctcctcacaaaaaccgtcgatagtcgcacgagcatcgtcgaggggacttttcacatgtacgagcccgatcatgaagcatcgggaaactccgtccatcccgatggaggaggttttgcggccccgcttcccggaatggaaggtcatgtcaccggcctcatcgataaatcgatgatggtcctgtggcccgtctactttctttatgctcatgcggacaagtctactatgcgtcacgttcgtcatttcccctcctcgatgacctgcgcgtctatcacatccctctcgtcgtgcaggtcagggatggctcggtcgaggagcgcggcgagactggccgtgtccctgtgggtgtagtggttggtcatgctgatgctggtgtggcccatgatggcggtccgggcatcgtcgggcatgttggcccgggcggtcatgctggcggtccagtggcgtgcgctgtggatggtgaccggcgggaggccggcggccttcaaggccttgttccagttgtggcgttcggtggagctgcgcacggggttgcctcgtgagttggtgaatatgagttcgcgcgggcctatgtcgagtcgtttgacgcgcgcccacaaccgttgccacaggctcgaggatatgggtacgaaccggtgggcggcgtgggtcttgggcgtggtgagccacaggatgccgtacaggtgctcggctttgagccaggcgggtatcacggcgtcctccggtttgccgtattgctggatctgctgctgcacgttgatgccgggcacgccgtcgcgttgctccagctcatagggcatgagcgcatatcgttcgccctccctcatgccggcggcgaacgcaagctcgaacagcagcatccaggattcatccacgtccacggtcagggccgggccgcggcgtttcgcccctcggttgggcactgcctcgatcagctgtttcggctggtcgggcgagaggatcctcgtctcggtgggctccacccttggcggcctgaccctgcggcatggatccacggggatgagttcttcgagttcggcctggtcgagcatcatcttcaggctcacgaaatggtccttgagcgtggagggcgcgagccgcttggagagcacgcgcatgcattggcgcacatggtcaggtgtcagatccgtgaggcgaacgcagccgatgacctccatgcacgcgtggatcctgccggcgcgtgtccggtatgtggtgggcttgacgttgagccggtactcctccagccaccgttccgcgtaatccttcagatacggcgacttggctccgggcagcagaccggtgcgctccatctccgcgatcctcgcgtcgaaccgttcgcgcgcgcccgccttcgtgcgacccttggccgagacgtagcgacgtttgcccgtggcggggtcgcggccgacctcacgccggaactcccacgagccatccttgcggtggatgatgcttcccgcacccttcgtgcgtcgtctgccgttcgtcgccatgatgttcctcccttgtcgggagcgccttcgagcatccgctacaagcgccctcaaaaagggcactctattggcacactatccgggccacaaacggccagatacggggcataatcgtccattcttcaataatcgaaaaacggcgcgattccacagttccgaagactcgaaaacgttggaatcacgccgttctctagggtgttcacaccctacttcgagacgttgaacttgaactccacaatatctccgtcggccatgacgtagtcgcggccctcctgacggagcttgccttcctccttgatcttggccatggagccgtcggcggccacgaaatcgtcgtaggagacgatgtcggccttgatgaagcccttttcgaagtcggtgtgaatcacgccggcggcctgcggggcggtccagcccttgtggatctgccaggcgcgcacttccttgacgcctgcagtcaggaaggtctgcagtccaaggatgtcgaagccgacgcgggccaactggtcaaggccggattcgcttaagcccgcgtcctcgagcatttcgcgggcatccgcctcgtcgagctcggtcaagtctgcctcgaactgagcgttgaggaacacggccggagccggggccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgccgcgcagatccttctccagcttgggcagcgcgttttcgatggtctgcaggtcggcgaggatcagctcggtgttgatggtgtcgatgtcgtcggccggatccaccttgccgttgacgtggacgatgtcgtcgtcctcgaaggcgcgcacgacctcgcagatcgcgtccgcctcgcggatgttggccaggaacttgttgcccaggccttcgccttcggaggcgcccttgacgatgccggcgatgtccacgaaggtcaccgtggccggcacgatcttctccgtgttgaccagcttggccagcacaggcagacgatcatccggaagcggcacgataccggtgttcggctcgatggtggcgaacgggtagttttcggccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggctcgaaggctttgactgtgatatgcgaatatacgcgaactctgattggcagtcagccgacgatggcatcgacggcgtcgatgaccgagccgcggaaaccgtccttttcgagctgggcgacgcccttgatggtggtgccgccgggcgagcacacggcgtccttcatggccccgggatgggtttcggtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcgcagccggccaccaccatggcgatgttcatatgcgcggtgtccacgcgctcgatgaggctgatcggcccgaacagctgctcgaaggtttcggtttcgtcgtcggtcagggtgttgacggattcggtgacgagcacgcccttgcccacagccatcggagtgttcggaatggtgcactggatatggatgtccgaagagtcaacggattcgccgtcttcggtggcgaacaggtcctggtacttcttgagattccagccggcggcgatggagacgacgatcttgcccggcttggcaagttcgtcggtcagcggcttgacaacggcggcaatctgatagggcttgatggcgatgatgaccacgtcagcggccgtcaccacttccagcgcattgtgcaacgggcgcacgccaagttcggcggtggtcttctcaagcttgtcgtagtgggcggcgcaggcaaccatctggccgccggtgaccacgcccgcgtcaacgaagccttgggcgatggcctgggccatgttgccatatccgataaaaccgatggtgaggttctgagtcatacgttttcctttcgtgcatgtatacagagctccctcatcagagggagcttgcttccttgagtcagaacagttcttcgaggtcgcctcggttgagggcttcggtgtagaggtgcttgaagacgagcgagccgtgcagaccgtcatgctcgaattcgttggtggtccagtagtggctgttacccacgcggctcaaggtgtcgagctgcataccggaatcgacatacatgtcgtcgaagtaaacggcggcctgcagcggcacctcattgcgggccagctgttcttcgtcatagatcacgccgaagtgcgtgtcttccatgagcaggtccatggccggcctgaacgggcgcaacgcagactcctgttcgaacatccacgggaacatggcctcgccggtgaagttgagcgggcgttcatcagcaccgaattcgggcttgccatcgcgcacgcgctgggcggcccagcgaatcggctgttccatctcaccgttggcgtagatgaactcctgcagcggccagtacagcgggcgcgacgaagtggcgttcatcaccttggtcaaaaattcgtcagacaacggcgagtcggcagaagcggaaccatcgccatcaaggaaggcgtcgtcaagaatccaatggacacgctcgaagctcggcttcatgccaaaatcggatcccaagcactggaagcgttcgacggtgagcgggtcgccgttcggcatcagcgggaagccgtgggcggccatgccggcgatcacgccaagtcgatgctccacatcggtaccagccatcggattcagtactgaatcggtgagtttgccaacgaattcggcgacttccgcagtagtcggcagcttgtcggcgatggcagccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttcttcagatagtcggcttgggctcgtgcgccggccgcggcatcatcgtcgtgcgcggcggcgatgcgggccatgacgtgcgtgtccacgcgcgaggaacggccggtgccgcgctggtcgggcagaatcacgcggaaatgcttggtggcctcttcaatccagccatcggaggtcgggctgttcaaacgcgggccggcaccgccgggaccgccttgcaggaagatcagcagcggcaggtcgtcatgcacatgttcgggcgtggtgaccacgcgatagaacagtttgatggtttccccgtcgaacgcccgcccgggctcgtggccggtccagtcgagcggaacatcgatggaatggtcctctatggccagtccgggcacgtagtatttgctcagcattgtcatggttcaagactctagtccataaatcctcctgaagagtgataccggttcgtcgccggacacgctagccttgtgcgttatggagatgatggcgcgcgtgagggcatggtgcgcacgggagtcgacccgcacactgctatgggacacgttgctcgccgcggcgctgatcgccggttgcgtgccgttcaacggcgtcaccagccctgattcgacgggcggcatattgtttcccgcaactcaggcatcgatgacgctgtggtcgctgccggtcttcgtgccgctgatgctgcgcaggtatcgcccggagccggcggcctggctgttcgtggcgctgaccatcacgcatcttgtgctcggcccggcgatcacgtatttcgatttctacgccctgatcatggtgtattcggtgattctgtacggcagtccccgacattcctggcggttcattgtcacggcgttcgtcatgggactggtcgcggcgacggtctggtcggtgtctttcaacgtgggtccgctgttcgccggaccttcctccggttcgcgcaccatccgcgacggctggctggccgatgccatcacgatgcccacatgcccggcggtcaccggcgtcgtgggggcaagcggcgccgtcaactgcggagccaagatgctcgctgacgtcggcatggaggcggcgctcatcgaatcgagcgtgctgagcgtcatcatcatggccttgtggcagcgagcgcgcaaggccacgctggcggccatgcgcgagcgcaacgcctccattgtggcgaaagaggccgaggagacgcgcatcgcggcgctggccgaacgcgcacgcatcgcccgtgatatgcatgatgtggtggcacatacactctccacgattattgtgcagtcggatggcggccggtatgcgggcgcgcatgatctggccgtcgccaagcatacgatgagcacgattcgccatgaagcggaacgcgcgcagcgtgatatgcagcgtctgttcaatgtgttcggtgcgagcggcagtaccggatatgccgacatcgattcactgtttgatggccatctggtggtttcccggcatatgaccggcaaagcgcaacctgaccggctgtccgccgacgcggaaaccgccgtgttccgtcttgtgcaggaagcgctgaccaatacgcgcaaacatgcgggcgagggtgctaaagccaccatcgatgaattctggtcaaacgatgtgctgtcgattaccgtatccgataacggccgtggcgcggcgtctgcagcagacggtcataagcccggatacggattggttggtatgcacgaacgcattgagtcgttgggtggcagcgtgcaggccggcccagggccgaatggtggctttattgtggcggctacgattccgctctcccctgccgccccacagtctggcaccgatacggaggatccggtgctaaccattatctcgcgtatacgaggattgatggatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgctgactataacgctgacgattattatgctttcgcctttggcgttccgccgccgcttcccagagggcagcgcactggtcatggcgattctgtccgccgtgcagctgctgtttctgccatccatcctgaccgtcaacatgttcgcattggtgtccgtgcatgccgccgtactgtatggccgcgaacatgcgtggcgctgggtcagcgtggcactggttgcggattcgtggctggccggcatcaagataatgtccggctggaacggctatgggatgctgattcagatgctgctgcccttcaacggcgaatcggcgatgtcccgctggctgctggtgctttccggtctgatgccgggtggcgtggttatgctgtttggctttgcctgcattgcgatggcccggtggagccgttcacgcggttcgaacgcgctggtgctcatgcaacgcgaggaagcgctcaaggccgagcaggagcggcagaaggtgctggccgccaatctggagcgcaatcgcatcggcacggccatgcaggccgaggtattgaatacgttggaatcggtgatcacgcaagccgatgatgggctggccatgctgaactccgaaccggctcccgatagcgagcagatcatcgccgcgttcacggtcatcggggaacgcgggcgtgcggctctggcgcacatgcggcaattgctgacggtgctgcgtgaaaccggattcagcgacgagatgcatgaaggcgcacaacccgacatgcaactgcgaccggctgctcctctgtccagccagatgaggcaggcggaatccacatctcagacggattcgtccacgaacatgaactcagggaacaatcagggtgtccatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcgcccgacggcgcccaagccgtggcgttggcggaatccctgcatcccgacgtggtgctgatggatgtgcgcatgcccagcatggatggcattgaggccacgagccgtattacctcgctctccgccgcgccgggcgacgcggccgattcggccagtctggccgccgacgcgaccgtctcggccgaatcggctgacgaccggccgacgcgcgtaatcattctgacgacgttcgatttggacgagtatgtgatggcggccatcaatgccggcgcctcgggcttcctgctcaaggacaccgaaccggaaacgttgctcaattcgattcgtactgtattccaaggcaatgcgattatcgcgccttccgccacgaagcgactcatcgaaaagatgatgcaggacggttacgcgcagcatggttcgttgggtggagaaaccacacactccggtgccgtgtacggttccgccggcggcgtctctggcggtgcggccggcaacggtgctggctcgatgaccggcatcccctcccctgccggagccgcttccgacggttccaatacgtcacgcccggcatacaccgatcccgaactggatctgcttaccgaccgtgaacgcgaggtgctggtggagatcgcccatggtctgagcaaccaggagatcgcggacaagctcttcatttctctgcccaccgtcaaaacccatgtggcacatattctggccaaaatcaacgcccgcgaccgcgtacaagccgtagtcttcgcgtacgataacgggctggtgtaacaaagctccctctgatgagggagcttattgccctacgcctcggccaaagcctcgacgggtggcgtcttgacggctcggcgggcgggagccacgctggccagcagagcggcgagcgcggcgacgccgagcaccacaccgttggtggcccattcgaacgggaacacggtgtcgccgtacaaactaaacaccatgtaggatccgagccagccgaacagggtacccaataccactcccaccacgccggagacgagcgaaagcagcaacgcttccaccgccagcgagcgccgcagttggccacgcgtcatgccgatggcacgcaaggtggcggattcgcgtgtgcgttcgatcaccgacagactcagcgtgttcgccacaccgaccaaggcgatgagtacagccaccgcaatcaaaccgaccaacaatgccatcatgccgttgatcatggtctcccattgcgtacgttcggccaccggaccggtcacggtaacacccgcactggcggagaacacattctgcacgttggtgaatacgtcgttcaacgcaacacccgcgccttcggcgtcaatgcgcataagcatgatatgcccgtcggccttgattccaccgttggtgaagtggctggcgtccacgaaggcgaccgcggcgtagttggaggcgatgcggcgatagtccaccttccgcggtttgagcgtcagcgtctgtgtgccgccggattgtccattgccgttttcggcgctgccattcgcatcattaccggacggaccattggcggcatcggcttgtgcttcggccgctccagccgtgaacgtgacgctcttgtccagcggaatatccttgcctgtagcggcggaatacttgggcatcagtacggaatcgccatcaatggttacgccggacaaatcggagcgcaccaccttgcgcagcgcgtcgacgccatccacgcccacgaccagcacactcaggctcttgccgtcggcatccttcatggtcatcatgcgggtcggcgcgtagacactgctctgaacgcccttgactttggctgcctcgctggcctgtttgccagtcatatcggtgccagcggcaatcatgtcgacgctgtagcgcgtggtcagcgcctcgttcatggtttgcttggcgctggcggcaccggtggcgatggtggagaccagcgtcacgccgataagcagtgcggcaccggtggcggccacgcggcgcgggttcttctgaatgttcgcatgtgccactttggcggacggaccggccagtgcaaccagcgcgcccacgccgcgcatgagcaccggtagccagaacgtggcggaaagcaccagtccaaggaagatcaatgcacatccgatgatggcggcgagcagcaccagcggatactgcttgtcggccattgaatcacgtccggcgatgttctcggacatctgccatacagagaatgcgcacagtgccacgccggccacaatcagcagcatggaaatcacggcgcggaccacaccggcccgtcgcgtgtcggtcagttcgatgggtcgcaacgcttccagcggggtgacggcggtagcggaacgcgcagagcctagcgaggcaatcaccgtcataatgatgccgaatgccataggcaccgtgaacaccggaccggatagcaccagtcgcatggtcatgccggtggctttcatcaggcccgactggcatagtgcggccatgagtccgatgcccaggcccactcccagtgcggaggcgatcagtcccagcacaccggcttcaaacagcacggagacatacagctggcttttgttcgcgccgatggtgcgcagcagggcgagtgtgcggcggcgctgcgccacaagcacttggaaggtgttggcgatgacgagtgccgcgaccagcatggcaagtatgccgaagctcagcaggaagatggtggtgatgctggtttcgcccgaactcatgcttttgacggattcctcgacgagcgcggcacgggattgcacgctgaaatgcttagggagcagtgtgctgacctgttttacggtggacgccgcagccgtgtcactggcatcgtcgatgtcgagatagacgaggtagacaggcaggttgccgaaatcgttgctgccggccatcgcggtaataacgttgtcggaaagcacggaagcgccaccgtagtaggcgtaggcaccgttcgggtcgtcggtgaggcctaccacgcgcacggtcatgccggagtcgacggctatgtcgacaccgtcggatgaggcggacgcacctgacgcggcatcggaatcaccgtcgtgcgagctcgtgccatcggcgttctgggccgactcatcaccagcgtcaccggtattaccggccgaatcgccggtcttgcccgcatactgcgccgcctgcgagttgacggtcacacggtcccctaccttgacgccaagctggtcggctacggacttggtcagggcaatctcgttgctgtccgccggctggtctccttgcgtgatggtgaccggcagcagcgtacgttttgcggcggtggtgatgacgtagctgctggcatgcttgttgccacgggttacggtcacggaacccgcgtagctggcgcgtgcgtccttgacgccttcggtggcgcggatgcggtcaagctggaagtcgttaaccgtgcgcgtgtagatgtagtcctggtccttatcggtcaggtccttgccgccatccgggctgatcacgtagttcgcgccgccgagctgggcagtgttctgggcggcaagcgcatcgttcatcgcgttgccgaacaggaaggtagcggcgatgaacgcagtgccgatcaggatggcgatgcctgccggaatcagcatcctggcgcttttcttcataagtttcagagtgatggaaaacatgggggtgtcctgtctctcgctttccgtctcagcgagcgtgctgtgcggcggcgcgggcatgatgcatggtgccggttctcccagctgggggcaatggagcgtcggtgatgggcaggttgggcacatcctttacgccggcaagacgggcgagcgtgtcggcgcgtgtgctggtgacggcagcgcgcgtggcacgttcgcgttcggccataagcagatcgttcatcgtttcggcagtgggattcgcctcgtcggccacgatctgtccgtcggcgaatacgatggcacggtcggcgtaggaggcggccaccgcatcgtgcgtgaccatgacgatggtttggccaagctcgttgaccgaacgcttcaggaagccgagcacttcggcgctggaaacggagtcgaggttgccggtcggctcgtcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgttcatgcgggtcaggtctgccccgccgaaaagaatatgcccggatgtggcggagtcgaggccggcgagcgtgtgcataagcgtggatttgccggagccggacgggcccatgatggcggtgaatttgccgcgttcgaaactcacgttcacgccgcgcagggcatggaccatattgctgccagtgccgtagttcttgaccaagtcgacggcctgaatagcgatgccgcgcgatgcggccgggttctgcacgttcataatgtctctccatatttggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcaccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtagtcgatgaccttcagcgcgttctcaacgtggcgttcgacgcgcagcgacagggtttcggtgccctgcagcagcaggaatgcggcgaacggagacagggtggcaccggtgtcgcgcagcaggatggcgcggatgcgggtcacgaacgcggatccgcccagggcctcgtagaagttcaatccgtgataggacggatccggctcggtcagggtcgggaacttgcccggcacttcggcccagttgaagttgccgccttccacaatcacaccgccgagggtggtgccgtggccgccgatgaacttggttgcggattcgaccacgacatcagcaccgtgctccagcgggcggaacaggtacggggtggcgaaggtgttgtcgacgatcaccggcagatgatgcttgtgggcgatggcggtgatggcttcgaagtccggcaggtcggcgttcggattgccgaaggtctcgaagtagacgagcttggtgttctcctggatggcgtcctcgaactcctgcggattctcggcggagacgaaggtggtggtgatgccgtcacgcggcagggtgtgacgcagcaggttgaaggtgccaccgtagatgttcttggcggcgacgatgtgatcgccggactgggtgatgttgcgcaccgcgtattccacggcggctgcaccggaggcgacggcaaggcctgcggtaccaccttcaagagcggcgatacggtcttcgaacacgccctgggtagagttggtcagacggccgtagatgttgcccgggtcggcaaggccgaatcggacctcagcgtgatcgaagttgtggaagacgtaggaggtggtctggtagatcggcacggcgcgggaatcggtggccgggtcggcctgctcctggcccacatgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcacggcgcaagctgaacgttatcggacttgcctataagggcttataaagccttgggatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcattttctgccgcccggttacatggtttacatgacgaacgactacagtcaaacatcgccaatgaattattccgccaacatggtgaagggattcgaacagacatgaccgatgtaacactgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacgcgctatgcagtgttcacgttccatgacaccacggatattctctccggttacttggatgcctggcagaaggaagacgtggagctggatggcgtgtattcaggcttcctcggctcccccgatcaggtggcaattattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtattgatgccgaacctcaccgaagcaagcattctcaccaagcgtgactatcctggccaggatattgatgaggccacggttaacgagctgcttggtgctctgctggagttgggtgccaagaacgtggtgctgaagggcatcgaccatggcgatggcaaaatcgtcaactatgtggccagcgcttccactggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgccacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgtttttcgtcacagggaagtcgactggtgagccttggtaaaccttctgaactaatggtggataaccgggttttcatccacacgtcatccacaacacgccaaaccgcgtcatagtatccacatttgccggttgcgcttgtgctcttacataagtaacccgcacagtggaatcatgaacgctttaccacctacccagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgtgtgccgcattcggcggtccgtttcgatgtcgtcaccatcgtgcttcgggtgggcaggccgctcgtgcatcacattgaaaatgccttctgaagccccccaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcggcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtgggtggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcgctgcaagtggcggcggcaggcgggcataatctcatcatgaccggcccgccaggcagcggcaaaaccatgctggcctcacgtatgcccggcatcatgtgtccgttgaacgaggcggaacaactggaagtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacgcgcgcgcatcgaggcattctgtttctggacgaggcaccggaattcagcgcacgcgccctgcagacgctgcgcgaaccattggaatccgggtatgtggcgctttcccgttcaaaaggcagcacctattacccggcctcattccaactcatcatggcggccaacccctgtccgtgcggatactattacggcaccggcgaacgttgcgcttgccgggaaaaagaccgtatacgttatttctcgcgattgtccggaccgatattggatcgtgtggatattcagatggcggtgccaccagtctcgcgcattgccgtgcaaagcgagccaatcggcgagtccagtgccgggatacaagctcgtgtgattcgtgcccgtcaagtggccaaggaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccaccgagcaggacgtccatcagggcatcgaaatgagaacgaggatgacatgagtaacgctactgatatccggcaatctggcggcaccgcaggcagtgtggatcacaccgatacgagtctcgctgtttcgcgcaccattcccgtacctcctacggatacgttgtatcgtgccgcgctcacgttctgtcttgatggcgcggatgtgatgatgtacgccgcgctcaaaggcgcggaaaacgccgaatccctctggcatgcgttggcgcaatcccacccaagccagccatctgaaatctgtggcccggcgctgtcacgtattgaccgcatgttcgtggacggcctcactcgatggggccgcaaggcgtcggcgaacgcgatgcgctccttccgcaatgcactggccggctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcagaaccgttgccgtattcgccggcgggctcaaccatatcggaccgatgcgtaaccgcacgctgttcgaacgtatcgaggcgcaaggcggtgcactgatcagcgaactgtgccccgggacgattcccgaagcccgtcgttttctgcttcgcaaccgcattatcgcggccatgtcttccacattgatcgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggcgtcacaggagtcgtcacaagattggcctttcgctgtttggtgtgggtgagtgggtcggggggtggtggtgctggtcgggtagtttgggggtatggataccacgtcgttgttcaccgccgccctgcaactgcctgacccgtggagggtgtcgggcgtggagttccgtgacgaggaggacggcagacgggaactgcatatcgcgatcgggttcgcggcgggttcgcggttcccctgcccggaaccggggtgcggcgaggccgcgtgtccggtgcatgacgcgagggagcgcgtgtggcggcatctgaacttcttccagtacaaggcgttcattcacgcgggcgtgccgcgcgtgacgtgccccgcccacggcgtgcacgcggtcccggtgccgtgggcgaggccgggaagcgggttcacgctcctgttcgaggcgatggtcgtggagctggccaaaagccagccggtcgcggacatcgccgagcaggtcggcgaacatgacacccgcctgtggcggttcatccgccattacgtggacgaggcgaggctttacgaggactacacgggcgtggaggccataggcatcgacgagaccagccggaagggccaccggtacatcaccgtggtcgccgacctggtggagcgcaacgtaatctgcgtggtcccgggcaaggactcgaccacgatcaaacggttcgcgcgggatttcatggaccacaacggcgatcccgaccgggtgcgtctggttacctgcgacatgagcctggggttcgccaagggcatccgcgagcggctgcccaacgcggcgagaatcatcgacaagttccacgtgatcaaacacgccaacgaggccgtcgacaaggtccgcaaacaggaggcccgcggcaacgcgctgctcaagcggaccaagtacctgtggttgaggaacgaatcgaacctgaccggcctgcaattggaaaccaagcgcagcctgcaacggcgacgattgaaaaccggacgcgcctgtcagatgcgcgagaccctccaggacatctacgacaccagcgccgatcgagccgaggccgagacggccctcaagcgtctgtgctcgtggatgacgcgctcccgactcgaacccatgaaagagttcgcccgccagatacgccgccactggcgggacatcctcgcctacttcgaccacccgtacaccaacgcgatcctcgaaggactcaacagcgtcatccagaacgtcaagacccgagcccgcggattcaagaacatggactacttcagcaccatgatctacctgacctgcggcaaactcgacctcagcaccgtcaccacctgacagacccacccacaccaaacagcgaaaggccaccggaaccggcgacccggccccgaccatcggggcctaccaaacatggtaatgggcaggctgtctttactgtcttcgatttcatatacgaatgaacttgctgccttgaaatgtcagtcagtgaggaattgcggcattcttgtggtcatcggtggctctctatatatacaaccgatctggaaacattcgttgttcactacggtgttttctctgcgtgacgttttgcaacgcaaacgtttatattcatcggctgataaaacttttgttcttggaacgaattttggaccgtatcgtaactcctggtacaagaagtcatatagcgacattttcaataaatatgttaccgatatctgcttccgtgaccaatactcgttccaactatttaagagtgatgagcatataagggtcgctccggatattttgttcggaacggaatttccacgtgtggaacgtaagaaaaaggtcctgttctctgttgttgatctcggcaatacgatgaaattccgtgatttatcttcatgttctgcggattatgattcgtggattgttaatgctgcaaattgctatgcgaatttgggatatgatattcaactgtgtggattctcaaccgttgagcatgatgatgtggcggttgcccgtatcagtcatctccttgcgcaggagtcgattcaacatgactgcttgacatatgataacgatacatctcggattctgagtgcgatagcggagtcggaagttatcgtgggaacacgattccatgcgtcgattctaggacttgctgctggctgtaaggtgcttccaatcatttacagcgataagacctcgcatagtttggatgatattggattcgcctctgatataagattggatttacgtaattttaagtctgacgatatttcaatctgtcgcaaagtacttgcaagagagcgcgtggacatcggcgaagtcaaaacgcagtctcaacgtcacttcatcggattagattgcgtattaggggtcggccgatgatgagagtttctggagagaagatcgtgagtggaattgtgggtacccactcgctcatgtgttttgaggtttggtgcgattatgtgtacgcaaatgcataatgtatcaggtggtcacttggtaatcagcgttatcgtgcccgtatacaacgttgagcgttggctggatcgttgtgtaacgagcattgtggggcagacttataagaacttggaaatcatcttgattgatgatggttctacggataagtcttcggagatgtgtgatgcctggtctcgtttagatgatcgtatccgtgttgttcacaaagccaacgggggattatcatcggctcgtaatgagggacttggtattgcaatgggtgcccggattgcatttgtggacagtgatgactggattgattccgaaatgctggccacgatgaatagatggatggatgagcaatccgctgtggatgtggtgatgtgcggtaccatcaaaaactatgagaatgggcgtgagcagtgcattgatggcgacctgccacaacgggttttcacaagtgaccaagcgctacacaatttcctgtatcgaagcaatcgcatggccagcgccgtatggaacaaactgtttgatgccaccttgttcaaggacgacgaagggaaaaccgtagttctcttccctgagggcctcgataacgaagattactatctgctggcgcatatataccgaaagatgcgtggaatctatttcaatcctcgtggcttctaccattattgcatccgtactggatctataactactgcgggaatgaatgctcatagcttggataagggcatcagttccgaacggtactgcaattatctagagaaaagcggatatacagataaagtggcgttggcttatggccgcatgcagggctggtatgacacgctctatgatgtattgaataagcaagcggatggcgcaacgatcgcgtattgccgacaccgtcttgccgatagagcgtcgtatgttttatccagcccgcaggtgtctgtattgcgcaaggccaaaatatgggcgatgattcatatcccgcggatatatcacgaccagcaccaccaccccccgacccactcacccacaccaaacagcgaaaggccaaatgttctaatactgtaatcagttcttcagccgtaacctgttaataatcctacattatagcggcagaaaaactcaccatatcgtcatcctcgattaacgattagatagacatacttttgcgaacaacacaggcaccaccgtatggaatgtgtccaacaaccgttggcaaagccaaatccctcacactattcgaacccggatgcgtctcaatctctgtcccccactagcggcgtatccccgtccaaagcagtctgggcgtcgagcaagtgggattcgatgatgcgcatccagaagaagggagttctcggcaatgttcagcggaacgagacatgggagtgtccagtgcttgggcgtgatcgtggagaacagtaggcagggagtcctcactgttgatggtggcgtactggccatcttcatcgcatacagaaacagtaggttgctactcgccgcgagcgccttaatgccacgccgactccgtccgtccaagcacatcctcaataaactcacgtccgcgcaataccgccagccactgagcgggaatggcatcgaatccatatttgatgccggccaggtatccggcgacggcggcggtcgtgtctgtatcgtcacccaagttgacggcggcgagcacacaactcgcataatcatcggtattcgcgaggcaccagagcgccgcctcatacgtgtctttgacgaagccgctcgaaccaacttcatcacgcggcataccgcgtagcggttcatcatccagctcttgcggccatatgcctttgatgagtccgtcgcgcaacacatccaccatgctcgaacaggcctccatcgagattgcatgagcgtgcgtgattgcagatgcggcacgtacgtcatccgcggaagcatccgcgaacgccaacggcatgatccgcatcagtgagccgttgccattgtctcgttcaccgcttaagcccacacgctgctgcaacgcgatggagaccgttcgcccgcaatcaaagactcgtccgtcaatcgcgtattcgccattactcagccatgccagatatcgctctcgcatatcttcagtattgacttgccattcattggcgatcagcgagtccaatgtggcgagcatcatgctggtatcgtccgaccatgtgccaatcggctggttatgcgtaccgtatcccgtcataccttcgcatcggaaggtatctctcggcatgaattcataaggcacgcccaaggcatcaccgactgcttggccacacacggctgctcttaactgctcgaatgttccgttcatcattgacgcctttcgatttatgcccctcactctacatatgtttcaacgataggtataatcgggcccactgagcacaagtgaggtgggtaatgagtctaagggagctaaggcagaagcgagggctatcgcaacaacgtttagcaagcaaggtagaaggcatgagtcaaggtcgcgtaggtgactatgagtcatgccggatacccatcgaaaacatgacgttaggcatggccttaaaattgtgcgacgcattgaaagtgagtaaccctcgcaaactgttagaggctgagaagccgaaagaaaacactagtgaaagctagttgtgtgccctaactcaatctttgagcgtaggccggttagcggcttaatcaggtgcaatccctgactacgcacgacggcggcactgccgctacataaatgccccgcaagcactagcaatacttgcggggctgacctttatcaatgcactcaatagaggcagtacccaagtgtaccgcctcacacggaagtaaggaaccatgactgacttatcctggattaccaagcaactgaccggcgaaactacaaagacgctgacagcacaccgtacacatctgtgtgagtatcgatccgccgctcagaactactttgcagagcgaaaacacggataggtcaagggaataccccgctgaatcgtcgtcagcgaagcaactcagagagttagtagaggaaaagcctcgctagtggccttttagtagagcaatgcctcagtccgcccgaggatttgcctcactgagactgctcagcgaagcaaaagctcgacttaaccgcagaatcacttctccagcttgtccagcgctttcagcagcgaatcaacatgacctttggcacgtacgttgtagcgagcaagcgccacggagccgtcgggattgatgacgagcgtcgaacggatcacgcctacgtgcaccttgccgtagagcttcttttcgccatatgcgccgtacagcttgtgcacggtcaggtcagaatcagacagcagcgggaacgtgagatgatcacgctgtgcaaacttgcgcagcttgtcaagcgagtccttggagacgccaagcaccgtaacgtttttcgacgccaatcgggcgagattatcgcggaaatcgcaagcctcggtggtgcaaccgggcgtcatcgcggccgggtagaaatacagcactaccttgcggccgcccttgagtacttcggacaaggtgagggaagtttcttgcgaatcaatatcagattcggcttcatcagatgatgcagaattcggaacaatcgccggcagagtgaaatccggggcttcgctcccctcactcagacgagcgtatacagaagcctgggcggaatcatgaacagtggtagtcatgcgtcccataataggtgtccgggcccacgacatttatcacggactttcgatgaccactgattgcgccaataattcggcacgttttatttgatagtaatatgccatcaaagcgtcagcagcgggctccgaaaggctcgactaatcacgcaactgtgggtcggcaaaacgacgattctgcagaaccggcaatattcggcacgtggattccaaggactcacgattcagctcggcaacgataagcccgactccctcatcatccgctgacgcaacaatctcacccatcggattgatgatacggctgcatccgatattccgcgaactcacctcgctgcacgccagcacgtaacacgtgttttccagcgcacgggcggcattcagtagcttccaatgctgttccttgagcgcaccacgcacccaagcagcacttacgacgatcacatcagccccgcgcacggccagtgagcgagcggtttccgggaaacgaacgtcataacaggtcatgacgccgatcttccaaccgtcaatatcgacgataggcggcaacgcatctcctgggagaaccacgtcggattcgcgggccgagaacgcatcgtaaagatgcagcttgcgatattcagcgataatttcaccatcgcgaatcacaaggaacgtgttggaaactcgggaatctgcatcccgttctgttccttgctccggcgcaacatgcacggtacccatcagcacaatatgccgctgcgcgctgatacgccgcaagccgtctacaaacggcccgtccagtggttgcgcgtgcgcggcagcatatgaatcgtcatcgccacgccgcgcaatcaaaccttccggcaataccagcaacttcgcaccgcccgccgcagcatcacgcgcaaatccgtcgagaatttccagattccgttccggctcctccgtcaccgtaaactgcgcaacagcaaccggcaaggacttcgcactcatcacaccagtcccaacgtcttgaaggcgttggccaggccgtcctggtgaatatcggtggtggtgaagtcacaaaaggcttggatgccgtggatggcgttgcccatggccacggacgtgccggcggctttgagcatggcggtgtcgttatcggagtcgccgatggcgatggtgtcggcaacggagtaccccagcaaagaagccacgtcgcgcacggcggcgcctttgtcgatgccgttgatgagcagttcgccgttattcggcgagatcttgtcgtatgagccgtgcacgagttcgaaccagggggcaagatcatgctgagtgttctcgaaggaaacatccggctcgggcccggtgaaatacgatcccttgctcacatgaatcgtgtgacccagcgtagatccagccggaacctctacctcgtccagcaaatgccagaaccgcgcaaactcaccacgattccacgtcttgcccttggactccagatggcggcgataaccttcggaaatgtacatgccgtccgcaccctgccactggtagctcttgatatggtgttcggcaaaataggccatcgccgcatcgatggcttcgggcgatacgaggtgctggaacagcagcttatcgccgatattcgcctgtgcgccggctacggaaactacaccgtcgaatccaagatccagaatgttgcgttcgattttcggcacggatcgaccggtgcagatgaagagcttgtgaccgttggcttgggcccgcgcacacgccgtttttgccgactccggcacaatatgattctcatcagccagcgtgccgtcgatatcaatgaatacgagtttgctaccagtcatgtcgctttccgtcatatgtcgaacctccccaagtcagcttacgctgacagccccctccagagggggcgaagagaaaaataaaacctgccgaaaaaggaaaagtactgctgacacctcccccagtcggcttggccgacggcttccgctggcggagaccaaaacggcatcacacggcgtaggcggcccagcggccgtgagtgtgctggacttcgatgggcatgccgaacaggtcggagagacgctcgtcggttagaccgtcttccagcgaaccggtatagacgatggtgccagcaccgggattgcccattgagtcgacgcccgcttcggtggcatcttcggcgggaatcggcttgcggcccataatggcgatgtgatcgaagcctgccggaatctcttccagacggtgggtgaccagcaccacggcacgttcagagctttcctcgccgattcggctcaacgtgcgcatcacctgctcgcggccgcccaggtcaaggccggtggtcggctcgtccataatcaaaagctcaggatcgcccatcagcgcacgggcgatcagcacacgggtgcgttcgccttcggacagtcgccacatctccttgccttccagataggagacgcggaaatcacgcagcagctggcgtgcgcgggcgtattcttcgtccgtgtaagtatcgcgccaacgtccggtcacggcggacaggccggtgaccacggcatccagcgggtcctcgaactcggggaactggcgacccaggtcggccgatgcgagaccgatgcgggtgcgcagcttgaacacgtcgtatttgccgagctggtggccgagaatgaacacgcggccttccgaggggaaggtgcgggtggccagcatgccgactgcggtggatttgccgatgccgttcggtccgaacagcacccaacgctcccccgcatggatggtgaggttcacgtcggtgatgatgacgcggcggttgcggcggaattcgacgttgtcaagttggaggacggtttgggacatgattctcctcagtggtacaaaacggagggagagcaccgcttattgcacggtctctccctccgtcacgctgcgcgagcctgcgctgtctcgcttttacttcttctgctcgtcgagcaccgactggtagacctccacggtcttgtcgccgatggactcccaactgaacacgtcgcgggcgcgttcgtagccggcctggcccatcttcttggcgagctccggatcggccatgatcttgtcgatggcggcggccatgtcgtgcacgaacttgtccggatcggtgggggtgccggtgccgtcgtgcagctggtcgatcggcaccagatagccggtctcgccgtcgaccacaacttccggaatgccaccggtggcggaggcgacgaccggcagaccgcaggccatggcctcaaggttcacgatgcccagcggctcgtagatgctcgggcagatgaaggcgtcgcagccgtgctccagagcgttcagctcaggcttcggcagcatttcctcgatccacacgatgttgccacgctcctcgtccagcttggcgaacgcgttcttgacttcctcggcaatctccggggtgtcgggcgcaccggcgcacagcaccacctgaatatccttggaaatcaggtgcaaagccttcaacagatacggcagacccttctgacgggtgatgcggcccacgaacagcagggtcggcttggaacggtcgatgttgtaacgctcaaacaccttccagcccggatcgtccggcgccggagtagcaaagtcagacatggtgatgccgttgtaaaccacaaccaccttgtctggatcaagattcggataggcggtcagaatatccttgcgcatgccaccggaaacggcgatcacgcggtcggcgtgctcgtaggcgtccttctcggcccaggagctcaggttgtagccgccgccgagctgctcacgcttccatgggcggaacggctccagggagtgggcggtgatgaccagcggcgtaccgtgcagcatcttggccaggtagccggccaggcaggcgtaccaggtgtgcgcatgaataatgtcggcatccacatcgttggcaatctgcagatccacgccgaaggtcttcaatgccgggttggcatcagcgagctcggacggcgtatcgtatccgacgaccttcaggctgcccttggcattagcggcattgggaatcgcggggatatcagcctcagtacgcttgccatcaaacgcacgcacggtcacgtcaatgcgctcggccaaaaccttggacagctcctcggcgtgtacgccggcaccgccatacacatgcggcgggtattcgcgggttagaatatcaactttcatcggactgcctctccttcgtgcgtcagaaagaaactcaagcacttcttactttagggcaccgcatacaagaaaacgcacaacttccgtcgtgcgttttgcttttcaagccggatttaccaggcaaaagatcagacggccgtgccgttctgatccaaattcggattgtgcttggaatcgccagccgtaaagaacaggctcagcacacccacaatgaacaccgcggaaacggtgatgatcagccacatcggatggcttggcagccacataaccacgaagaacgcgataatcgcgatggcgatcagcgtccagctgcccacgcggaaccactgacgcagcgaatgcggtgccttgaacatcttcggattcgtgtagttcgggttagtggtcagcagggtttcggtgtccgcaatcgtaccgccgctgggcttccattcggtgccgtcggtgccgtcctgcagacgctgggacttctgctgcagctggtattcgtcaatcattcccgaacggccacggccacgggtctggtcatactgcgacggcactcccctgcggcctgctttggcttgggcacggcgttctgcacgattcggcatttcactactcctgtttcgacggtgacactgttggctatattactcgcttatcggcggcaatttgccaccagtccatcggaacccactgtgtgtcattgtattttcagtcagtgatgcgggcagtcggtgatgcgataggtttgcgtatggaagtcgcaagtgaccgcagtgccgtccgcgaataccgaacgctgcaccagcggatcatcatccacgaactcgtgacgaaccagttcctgcatgccgacccgctcatggaatgcagcgaccgtatggcagcgttcgatgtcgttttccgtgcgagcgcgctgttcgtcgtccatgtcgccgtcaacgccgatgtatgcggcatcgcgaatcaggtatggagctccgccgttgagcaaggcgtacagcatgtaatcgtcgccgtccaccacacgctccatcatccacggctcgataacgcaatcatggtagacgaggttatacagcggcaccggcacaccttggcgcggctcgttgggtgagcgcatctggaagtcgtatggcgcgtaatggcagaatatcaggcttggcactgcccagtccgatacctcttcggacgaggagaggatgccgtgcgagagcagatattcgaagcattcggcgcggcggtcaaagcattcgcggcgggtcatgcggtgttcggggttcgagcattcgtcgccttcgttgcaggtgaagacatccaagtatgcacagtcgagtttgatgccgtgtgcggcgatttcggcgaaattgcggcgcacgtagtccggtgcgagctcggcgcacaggtaggtctggcggccgcccgcccagcgtgcgtgttcgggcatcgtaccgtctgccagccgaatcgcattgttggcatcaaaggtttgcgcggtgaagtagtaatcgcggtactggtcatgcgtgccgaaaatatcgccttgctcatggcaggcgtcgaccagcgacttcatgccttcccagccgcctgcctcctgacaggccggcagatagtcggggtgtgcgttgtcgtatccgggctgtgcccaaccatccaagtgcatgtacagtcggcctgcacccatgctgtgcaatgttcgcatttgcttttcgcgctgtgcgaaggtgaccagtgactcgtttttctcggggtggtccttatcgtagtagtacgagtcgggctgtactttggttttgatgccgatgtgcacccatgaacgaccaatcaggtcacgcacggagggattgcgcgccgccttttcgacgagcgtacgcaagcgacctcgttcattgacgtacgaacgataggccttgcacaccgccgtgtgatcggcgtggtcgaggaactggtagcgtaccacgcggcgataattcattgtgccgaggcttggctcaaaccaagtattgatatgggtgtacgggccattgctgggatggtcgatgccgtaaccggcattccatggagtttcgcagatggcgatatacccgtgtccgtctgcgcggagctgcgcgaaccacggcatgtaaccgccagccgtttcgaagcggccgtcgaaggcgatgtctttggtgctcacggcggtaggccatgtgttggggatcatcacaccttgctcatgggtgatgagtgtcgtgtcatggtcgtcggcgcaatcgaagtccatggctgcgggccacgtcacattggtgatgttcaggccttgctcattgagcggaatccattcgaagagcacatcgcctgaggcacgctccacccatacataggtttcaaaggagtatgcgctgtgcccaaagccggtgaagatgctgcgaatgccggttcccgtgccggtttcacgctgctcatgggtgatggaagtggcatccgcgaacgcgaaggtgccttgcgcgcattgcagggtcggcttgaaatcagcgcaggtattccattcggcaccgtcgcgcgtaaaagcgaactgcattgttcgttcatcgaatcgcacggtagtgccggatacggtgaattccatagttaatgtgctcctgtatgttctcgattgctcccgcttacgggagctcgctcatataacaagattaggggtggtctgctgtttgagaccacccccagtcggctttgccgacagcccccgccagcggggggctagcgctgtctgtttattacttactgcttactgcttcttggtcagtgcggtgaacactgggccgccgccgtagtcgaatgcgacgccggagattgcggaggtgctggctgcggtggcattctggttccacaacgggatagccggaaggtcctgcagcagaatctcctcaccttgctgataatacttgtcggcttcctcggtggacggggcggaaagagccttgtccatcatggcatcgaactcggggttcttgtagttgccgctgttgccgcccttgccgtcggccgaactggaatcgtacagctgtaccagatagttgtccgcggatggataatcagggccccaaccgctacggtatgcggaggtcatcttgcctgaatccacattggacaggaattcgtcggaagtggacatcgggatgctcttggcatcgatatccagcgtgttcttgatgtagttgcagattgcctcaacccagttcttcgcagtgccatcagcattgtatgcaatgccgaactcaccgctccacggggagatggcgttggccttggcccacagttccttggccttggacgggttgtacttcagtacttcatttcccttgagttccttggagtaggcgctgattggggctgcaaggaagtcgacggcgggcgtggcggtaccgtggaagatcttctcggcgacggtcttgcggtcgatggacatggaaatggcctgacgacgcaggttgccttcctcgttctggccgaagtgttccagccattcaggaatggtgaaagtgagcgtattgccaccgggctcgttgtatgccttcagcgacttgtcggattggaaggaggtaagtgcggtgtcaggaatcgtgttcgtgaagtccaggttgccaccgcgtaggtcggcgtatgccgaatcaggcgaggtatagatcttgaagttcaggccatcgttcttggcgacacgattgcccttgtagtcagggttcttcaccatttcgatgctgtggttgtgctgccaggacacgaacttgtatgggccgttgctcactgggtgctgaccgaacttcttcgggtccttgaacgcggattcgggcaacggcatgtaggcgtggctgccggccttgaccgggaatgccgagtcgggctggctgagcttgacatcgatggtgttgtcgtcaacgacggtcaggccgctcagcgtggccttggggtccacgtccggcttttgcagatcatcatagccttcgattgtgctgaagaagctggcgctggcctgcttgttggcactgttggcggtgtaattccatgcgtttacgaaggagtgcgcggtcaccggagtgccgtcggtgaacttccatccgctcttgagcttgatgacgtaatgcgtggcgttgtcgctggaggtgatgctgtctgctacctcgttgtggatgccgcccttcgcatcgtaggtcaccagacctgcgaacagctggtctacaaccttgccgccaccggcctcagtggtgttgccgggggaatagtgggtgtgccggctcactgccgtacacggaaatgatattggaatctgaagcattgctggaattggaggtaccggtcgatccgcagccgctgagcagcatgacgattgccgcaccggccgcgaccagtgaagtgacatggcgtgtgttcatgaatctctcccaaatattctggcgtcatctttttggcgacgaaagacaccataggagcttcatgttaaccacgtatgcaatattctcgaaatataaacattactgaaggctcaaggcagtaattaatcccagaaacgcaaaaatcccctcacgaagaagggattttcatgtttctgtttggaaagtattcagcgaggcagcatcatcggacgctggctggccttgatcggggccggcagctcgctcttttccttggagaggtactcgtccacggctgcggcgcaggagcggccttcggcgatggcccagaccacgaggctctggccacggccggcatcgccgcacacgaacacgccatcctgggaggtggcgaacttgtcattgcgagcgatgttgccacgcttgtcgagttcgacgggcagctggtcgaggatggtctcggtgtccgggtgcaggaagcccacggagatgaggaccagatcggcgggcagcacgcgctcggtgccaggctggcgagtgaacggaccattttcgccgggagccacggagacgaccttcaagccggtgacatgaccacgctcatcggccacgaagccttcggcggtggtcgagttatcaatggtgaccttggccttctcctcttcggtgccctcgaagttcacggagtcggtggagtagatgtactcgccgccctcttccatggaggaggtcttctggtaggtgcgggcgaaggtcggccacgggctgttgtccggacggcttgacggctctttcggcatgatctgtagcacggtgacgtccttcgcaccctgacggatcgaggtgccgaggcagtcggaaccggtgtcgccaccgccgatgacgatgacgtgcttgtccttggcggtgatgtcgtgcaccggcttgacgccgaagatacggcgcgtggcgtcgggcaggaagtcgagggcgaagtggatgccgtcgagctcgcggcccggaatcttcatatcgcgcggcacgcgggagccgatggccactacgacggcgtcgtaacggtcacgcaggtcatcccacgtgatgtccttgccgatttccacgttggtgcggaagcgggtgccttcggcctccatctgcttgacacggcggtcaagcagacccttctcaagcttgaagttcgggatgccgtaacgcatcagaccaccgatggcgtcgtccttctcgtagacgacgacggtgtggccggcgcgggtgagctgctgtgcggcggcaaggccggcagggccagagccgacgacggcgaccgtctggtcggtcagacgctgcggcggcagcggcttgacgtagtccaaatcccatgcctggtcgatgatggtctgctcgtcaagcttgatcatggtcggcggctggtggatgccgagcacgcaggcctgctcgcacagggccgggcagatgcggccggtgacttcggggaagttgttggtcatggacagacggttgtaggcgtcttcccacttgccctgacggaccaagtcgttccactcgggaatcaggttacccagcgggcatccggtcatgcagaacggggtgccacaatccatgcagcgggccgcctgcgtttgggtccacggttgcaggccggtttcggcgtgaacgtcgaaccagtccttgatacgctcctcaacggggcgttcagccaactctcggcgggtacggaccttcaggaatcctctcgggtcgcccatgtcagcgcgctccttccataacctgctcgtacaccttttcccaggcgccgggcgcattgaaatctacattgttggccttggcttcttccatggccttcgtcatggccacgaactgcttcggcactacgtgcgtgaaccgcttgacggtttcgttccagtcctccagcagggccgcggcgaactgggaaccggtctcttcggcatgctgcttgaccagtgcgtacaccagcttggaggtttcggcatcaagcgacttgaagagcagtgcaccggacttgatggcacccgggttgaccttcttcatatcgaggtcaagcacataagtgttaccaccggagaagcctgcaccgaaattgcgtccggtggggccgagcaccacaacagtgccgccggtcatgtactcgcagccgtggtcgcccacgccttcgaccacaaacgtggcaccgccgttacgaacgccgaaacgttcgccggcgcgtccggccacgaacatctggccggaagtggcgccgaaaccggtgacgttgccggcgatgacgttgctgtgcttgtcgaaggtgacgctatcttccgggcgcacgatcatgcgaccgccggacaggcccttgccggcgtagtcgttgacttcgccgtagatgcgcatggtctcgccgcgcgggatgaacgcaccgatggactggcctccggaaccgtgcagggtcatgtcgatggtgtcgtccggcagaccttcctcgccgtaacggcgggtgatctcgtagccgaccatggtgccgaccgtacggttgacgttgcgaatcggcatttcgatgcgcacgggttccttgtgttcgagggccggctgggcaagttcgatgagcttgttgtccagcgccttctccagctcgtggttctgctcgatggtctggtgcaggatcgtgccgggtaccgggccggcctgcttgagcacgttggacaggtcgatgccgctggacttccagcgcttgatggcctcgtcctgatccaagcactcaacgtggccgatggcctcctcaagagtcctgaagccgagctgggcgaggatctcgcgcacctcctcagcgatgaacatgaagaagttgaccacgtactcgggcttgcccttaaagcgggcgcgcagctcaggatcctgggtggcaatgccctgcgggcaggtgttcttctggcaggcgcgcatcatgacgcagccttccacgatcagggctgcggtagcgaagccgaattcctcggcaccaagcagggcggcgatgaccacgtcacgaccggtcttgagctcgccgtcgcactggacgacgatgcgggagcgcaggccgttcaggatcagcgtctgctgggtttcggacaggccgatctcccacggggtgccggcgtgcttgatggcgttgagcggggctgcacccgtaccgccgtcatagccggagataagcaccacgtcggcatggcacttggccacacctgcggcgatggtgccgacgccgaactcggaaacgagcttgacgtggatacgtgccttcgggttggccatcttcgcatcgttgatcagctgcttcagatcctcgatggagtagatgtcgtggtgcggcggcggggagataagctccacgcccggggtggcgtgacggaccttggcgatccacggcgggaccttggctccgggcaggtggccaccctcaccaggcttggcgccctgggcgagcttgatctgcaaatcggtggcgtgcacgaggtaatcggaggtcacgccgaagcgggcggacgcaatctgcttgatgcggctgtagcgctgcggatcattgatacggtcgtcggattcgccgccctcaccggagttggagcgtgcgccaatcgagttcatggcgatggcgagcgtctcgtgtgcttcctgcgagatggagccgtagctcatggcaccggtggagaagcgcttgacgatctcggaggccggctcgacttcggcgatgtcgatgggcttgcggttggtgttgaacttcatcaggccacgcagggtcatgagtcggttcgacgtgtcgttgatgtggtgcgaatacttcttgaacatctggtagtcgccacgctgggtggactgctgaagcaggaagatggcctcgggatcgttgaggtggtcctcgccggtgcgacgccacttgtagtcgccgccggtgcgcaggttgcggtgcggggacgcgctccactggttcgggtaggccacgcggtggcggatggccacttcttcggcgatttcttcaaggctcacgccgcccacacgggaggtggtgccggtgaagtattcgtcgatgacttcttggctcaggcccacagcctcgaacagctgcgcgccacggtagctcatgatggtggagacgcccatcttggacatgatcttgagcacgccggtggagagggccttggtgaggttcttcacggcggtgtccgcgtcgaccttgaggtagccgttgcgggccagatcttccacggattcgaatgccaggtacgggttcacgcaggcggcaccgtaagcgatcagcagcgcgacatggtgaatctcgcgcacgtcaccggcctcgacggccacggagatctgcgtacgggtgtggcggcgcagcaggtggtgctgcacggcggaagtcagcagcagggacgggatcggaccccacgtatggttggactcacggtcggagagcacgatgaagttcttgccgttggcgatggcctcgtcgatttcggcgaagatctcgtcaagtcgctcttcgagggccttgccgccgccggcgacctggtagaggcccttgaccacgtacgggcggtagtagccgccgaggatgcgggccttgtcaaggcgcttgagctgggccatctcatcagagttgaccacgggcagcgggatgaggatcttcttggcgtgcagctcggaatcggccagcaggttcggctcggggccgatggcggattcgagcgaggtgacgatctcctcacgctcccagtccagcggcgggttggtgacctgtgcgaacttctgggtgaagtagtcgaacagcatgcggctgcggctggaaagcgcaggcataggcgcatcgttacccatggaaccgagcggttccttgccggtgttggccatcggcgtgagcaggagcttcagatcctcttcggtgtagccgaaggcgcgctgacggcgctggacggactggccggagtggctgacgtgctcgcggcggggcaggtcgctcatttcaacggagttgccttccacccacttgcggtacgggtgctgggcagcgaggttcctcttgacctcttcatcgggaatgatgcggccttcggcggtgtcgaccaagaacatctcgccgggctcaagacgacccttggacacgatgtgttcctgcgcgatctccggcagaacgccggcctcggaggccagaacgatgtagccgtcatcggtgagctgccagcggccgggacggaagccgttgcggtcgagcagggcgccgacctgggtgccgtcggtgaagacgatgtcggccgggccatcccacggctcgataagcgtgttgttgtactcgtagaaggcgcgcacgtccggatcgagatccgggttcttctcccaagccggcggcagcatcatgcagatggcgtgcggcagggagcggccggcgaggtgcagcagttcgaggcactcgtcgaaggtgccggaatcggagtagcccggggtggtgatcggcagcagcggctcgaattcaccgagcagttcgctgctcaggcggccttcacgggcggagagccagttgcggttgccctggatggtgttgatctcgccattgtgggccagcagacggaacggctgggccagcggccagctcgggaaggtgttggtggagaagcgggagtggacgatggcgatggtggccttcatgcgctcgtcgttcagatcctcgaagaagtgggtgagctgcatggtggtgagcatgcccttgtacgtgatggtacgggcggacagggatgcgaagtagacgcccacctcatgctcgacgcgcttgcggatgcggaaggtcttgcgatccaagtccacgccggccagagcaccgtccggagaggcgaccacgagagtcttgaatcctggcatggcggcaagggcctgcaggccaaggccgtccgggttggtgggcaccacgcgccatgcgaggacttcgagtccctcctcgcgcacgatcttggcaatggcctgttcctgctgaccggaggtttcgatgtcgcggtcaaggaaggcgatgcctgccgcatagtgaccggcttccggcagttcggcgggcacggtggcacgcatgaactcatccggcatgctcatcagaatgccggcgccgtcacctgtgttctcctcggcacccacggcaccacggtgatcaaggttgaccagcacctcaatggcgtcggtgacgatcttgcgctcaggacgcttgttcaaagtggtgaccatacccacaccacaggcgtcatgctcgttggcgggatcatacataccgtccggagcgtggaccgtgagatcgagcggggctttgaatgtcaccgaaatcacctcaattggttgtgggcacgtaagaaaatcatgcctcttcgttcattgctgttgacacagtaccgtcgctccatgtcatttacgtttcatgtgtccatataccgagtcgccataaaagtcaatagtgattctcaagcaatttttttatggccagttatgggggtatttcgaactttttcgctcgaaatgtctatttgaccacacgaaaatacgatacggaaacgtccgtatcgtgaaatgctgcgttgggtgatgttacggattggcggctgtggaccaccctcagtcatgcttcgcatgacagctcccgccagcgggaacatgagaactgtgcatgtctgacaccatagcgatcggcgcgctccgcgaactcaccgaacatggcatccacgcgcccgacgacgtacggctcatgggattcgacggcatccccttctccgcctgcaccaacccacccatcagcactgtggcgatggacgtccccgcaatggctcgtacggttatcgatcgcatggtggcgccgatcgagtcgaacctacggcatgaacggcccgatgacatcacccatgaccatatccagttccaggtgatgccacgcacgtcgactctgtccgcctgataccggccggcacccttatgagtgccggccttcatccttgaaaatatgaaggctatgccacgtacagcgcggcgggatacgtaagatacgaaatctcatcgagctgatcgaccgtcacatatccggctggcgcgttgagcacgtccggaatgcggttgacgattgtggcgcacgtatgttcgacggtcgccggcttgaccacgtggaactccacgtccggttcaccctcgatcttccaatcgcacatatcgccatcatccggcccgtacaccttgccgatacaggcagtttccaacgtgatgccctgattagtttcggtggttaccacggcggacatgccgatgcatttgccgaccggaatcatctcgcccatcgtttcggaatacacgtcgacatcgctgaaatacggcacactggcctgggtctgcgatgcgatggtaagcccaagcttctgggccagcgcttcattggaattccatacatacgagggcaccacggtttcgggatgcgcaagctcggcctcgaactcctcggcggtcagaccgcaaccgtgcgctttggccaaagccaggccgtaatcctcgacgttgtagctcaccgcaccggtgatcttcttgatgctgtggcatccggcggcgacggtggagaccatgttcacccagtagatgtcctgcatgccggagccgaccatggtggcaccggcttccttggcgatgatgtcgagacggttcgtggtggccggatcggtggtccacgggtagatgcattcctcgcaggtggtgatcacgctgatgccgcgggccaagcactgctcgcacatggtggcgatttcgttctcgaagctgaatagcgtgactaccgcgatatccgcgtcgcactcgttgagtacagcctcggcatcggcgcgaatcggcacattgatggggccgatgcctgcaaacacaccggcatccatgcccacgacttccggattcacgtcaatggcaccaacgatttgaatgcctttctcgtgcatatagcgaatcgcgtacttcgccattttgccgcagccgtattgaatggctttgattggttgcataccgcatactcctttgcaacagtgcatattggccattggagaagtctcaccgtcgagaccaagccaatagcctttactctaccgacatcaggctgggcattcactgatatcggcggcactggagtgtcggggagagtcggtgtagcggtaccactaccgaacagaagggctggggccatcacgaggtctcccgccgaatcacggcatctcgctgattttctgcccgccgggcaggggcccatgcccatcggcgtatgcgccgctgatctggccgaatccaacgacccgagagaacgacgcgcaggggctcgaaacccttacagaactcatcacggcatacaacaaggaaatgagcaatgatttcccgcattgcaatccccagcggcgctcatccgtggaatatcgtatacatggtggccgagcgcattgccgaatcatgactgctcaccggcggtctcatggtgcagttgcacgccatcatgggcggtctcgacgtgcgtcccactaccgacgcggatctgtttggcgcgctgattcttaagagcgccgcataccaagcagaccatgccggatatggagatagacatctgtacgatgccgcaatgctcgcatccctcatcaccgaccctgacgccgaaacttaacgactacatagccacacggatcgcagacgtatcaagctcccgtacgacatgctcaccgatgaatcaccttaccggaacaaccttgacgaacaacatcgcagaacaggattcgatgccatagagacactggccgattggtagccgctctaccgaacccggctgtggcggataccagtcagaccaatcccgcctacaacctacttccggttacgtagggcgtggagcatggcgacgaacacgataacaatgaccacggccatgatcgcacagatgagtttgccggggatgcgttcgtcgcgggcctattgcatcgcggcgtctgccgctgagatagtgcccgaggtctggggctgagtcttcagagttgccgattgttcaaaagtcatactctaacgataatgctacagaaagcggttaccataaagcgtgctcacagtcgcccgtcatgcggacttttcgaaaactgttgataaatagccattttccgcaaaagcccttgcaaaacactatgatttagaatatctattagtatgacgtaaaccatattacaaaccacttaaggtaagcgcttacagttcggcatgagagactcctcaccacgatatggatgcgctacagtcactatgattgatacgcacgccccatcgactacgcgatttcgccgtcgccgtacgcgcgttcggaggctcgcagacacggcttgccttgcaccacctcgacctgcgagggcggcgcgtcatcgccggcgcgcttggcctggatctgttcgaacagcattcggaaggaccgctcccccatgtccaggaagttctgggtgtaactggtcagcgccggattccacatggcaccgaagttgcggtcgtcaaagcctacgacgctcacgtcagcaggcacgcggcgaccaacctcccttagaccccggatcacagcgatggcagtctcgtcgttgccggcgaaaatcgcagtcacatcaccacgacggcccaaggtgcgtccagccttgaccgactcctccaaatcatcgtcgggcacgatgattgggtcaggtgccgtgacgccgcgctccttgagcgcgtcacgccacccattggtgcgggtgttatcggtcggaccttccggacgccccacatggaacacggtgcgatggccgagatccagcagatgcatggtcatccaacggccgccatccctttcggcgttgatgacctggtattcaccgtcgccgaagctgccacccaccacgaccatcggcatatctttgggaatgtattccagtgcggcgatgccggcccggtcgtactcgtagacgatcacgcccgccggcctgatcgacaaacccatgcgcacgcgagccttgacggagtccatgtcggactcgtccaaagaaacaatattgagcaggaaccgacgtttacgggcggcggcctccaccccatggttcgtttcggacgtggagaaggcggaaggattggccgcgaacaccaccacggagtccatctcccggttcgacagagcgcgcgccacaatgctcggctcgtagcccagctccttgatggccttggcgatgcgttcacgcttgtcttcggtgacgttgacggtgccgttgagataccgggagacggtcggtgccgagactccggccagtttggccacgtccttgatcaccggccgggtgcggcccgcacttctcgccatccttgtctcccctgttgttgtcagttgttgttattgcgtatgttagagaaccggcatcactatgacagccatccagtcacacccatatccgttcagccgcgctccgacttcggttctccgtttttcgccgcgattcattgtagttcatgacggggaacctatacccaaatcgataacttcgtgaaaaccgtacgctgagttgcggtgagtgtacggtttccgcgaaatcatccctaatttcgtgaagaacgtacactgaatcgtcgtcaacgtacggttttcacgaaatggggcctcatctcgtgaagaacgtacactgagtcattctgagcgtacggttttcacgaaatggcagctgatttcgtgaagaacgtacgctgaagatgcccccggtgtcactgatgactgttttcggtatggaaggcggcgcagcaaggtgtcctaggctaatatcgcctccgacaagaccgtcggcaaagccgtcgacgtcgattcaagttatccacagcaacaattcgcgtgacatagtatccacatttgccggttgagcttgtgcaacgatcaaaatcacccttagcgtcgagatatgaaagaacacaaggaagtttctgcactgctgcagcaggcgaagcaggagcgtcgctgctgctatggcaccagtgatgcgcaacggcgcgccctgaaacgtcgcctgcatgccggggagctggtgtcaccgtataagaacctgtacgccgaccgaacactttggaacaccatgaccagagagcaacagtcattgcaggtcatacgtgcgttgtccgcaatccaccctcagtgggtatttgcggggttgagtgcggcgtgcgtatacggactgcagcacaactattccctgcacgacggcacagtgcacatcgcctcgaagtccggcatcggcggcggagacgaggcgcgtctcaaccgcatctatatcaatcggattccgacgcggaagcataacggcattctcttgacgactccggcgcgaacgctgctcgactgcgcggcattcccattcccacaggcgctgcccatatacgattcggctctgagaaagtccctgacgaccatcgaagaggtgcagtcgctgatgattcaaagcgtctgcgacgaggtctccgtgaccaagctgctgaagtacgcggatcccctgagcgaaaacggcggcgaatcattgatgcgtggccagatcaccgaattgtctttcggcatccccctgctgcaggtgcagttcatgaatcccgacaatcccgcaatgtcatatcgcgtcgatttctgttggaagctcgcagacggccgcatcatcgtggcagaatacgacggcatggccaaatacgccgacatcagcaacaagaatcgcgcaagcctccaggcgaaaatggagtacgaccgcagacgtgatcggcatctccgggaacagggcgtcaccgaaatcgtccatgtgttctatgaggatctgctacgccccatcaatcttgagaccaagctgctcaaggccggtgtgcccaaaatccggtgaagataggccccatttcgtgaaaaccgtacgcccagaacgactcagtgtacgttcttcacgagatgagaccccatttcgtgaaaaccgtacgcttacgacgactcagcgtacgatttccgcgacatgaggccatacctcgtgaaaaccgtacgctcagaacaaggccgtcagaaggtcgactagacagcctcttaactaccgaacggtatctaaagaacggcgatattccgccagaaacgccgagagcggaatagtccctttgcgtttgtcatcggactgcgttattctgaaaccggtttcagaaagaagccgataaacaaaactcaaagccacaaggttttgaccaacgaaaggaaacatgatgtctctcaaggattccatgattcgcggtctggctatgtacggtgccactcccctagcccagtccggtcacgcctactcccagatgattctcgacatcatcaacgacaccgacaagaacgctcgctgagcctcttccctgactcgccgctcgcacacagcccgtctcataacgtaaacaacaacacattgcaaagcccacggctttgcaagtcaagacaaggaacacattatgtctctcaaggattccatgattcgcggtctcgccctctccggtatggatgccatcgcccgcgccggctacgccgactccaagatgttcgccgacatcatcaacgccgccaacaaggacgctcgctgaatctagcgaacaatcccgttcatgagattgcatgacacatacgaaggcaatccccctcaggccgcaatcggccggcacaccacaataattgaataacgcaataattcaacacagtaaaactgaacaataaccgggacaacggggtccatatattctttcttttcccatcgtgcgtacgccgcgccagcacaggttcacatacgatgcacacggccgccaatacacgatgcgtcatcatcaacgccctcaccgcatcatgagatactcccccgtccgttgtccacactgttgcctctacaatgcctgtgatgcacgccgaacggcatcctgcacagtgactgaagaacgaaacaccaagggacggaaatggataacgaactcttcgaaaaggcgccgattccgaaggcgtatttctcgctggcgatgcccgtggtgctcagcatgctggtcaccttggtgtacaacatggtcgacacctatttcatcgcgcatacgggaaacaccgatatggtggcgggcgtctccctcaccgcgccagtgttcaccgtgatgatcgccctcggcgacatcttcggcctcggcggcagttcggtcatctcgcgcttgttcggccaacaccggttcgccgacggcaagcgactcagcgcgttctgcttctatgccgccatcgccaccggcctgctgattctggtgctgggcctggcgttccgcgacccgatgctcgcgctgctcggcgccactgacgacacttggcagtatgcctccgacttctacacgctgatcatcgtcggctcgccgttcatcatcgtgtcgatgacgccgtccaacctgctgcgcaccgaaggccacgccgtgcagtccatgatcggttcggtggccggcacggcggtcaacatcgtgctcaatccctgttcatccacggattcggctggggtgctgcgggttcggccggtgccaccgtgatcgccaacatctgcaccgacgcctatttcgtctggttcacgctgcgtcacagcagcaacctgtccatcgacccgcggaccgtcatcgaccgcgcgcgccggcgtctggcggtcacggcccgggaggtcgggagcatcctcgccatcggcatcccctcggcgatcacgaacctcacgcagagcgtcggcatcgtcatgatcaacctgttcctgctcccctacggtaccgacgcggtagccgcgatgggcatcgcgctgaaagtcatcatgatcgcggtgctggttttcgtgggattcgcgttcggcgcgcagccgctgatcggctacaactacggcgcccgcaatatgcctcgactgcgcggcattctgcgtttttcctacctgttcctgtccctgttcgccctggtgatgaccgtggtgctcagcctgtccgaccgtctactgatgggattcttcatcgaggacgccaccatcatcacgctgggcgccggcatgctgcgggttcagctgctgagcctggtgtgcgtagccgtcgtgatggtcacgacctgcaccttccagtccgcaggcaaggcggtcggcgcctttgtgctgtcgatcagcaggcagggtgtgatgctggcgattaccctgttcgtcggctcccggctggccggctatcagggtgtaatcgccgcgcaggccatcgccgatctgctgaccgcgattgtggcggtcatcctgttcgtcgtgatgttgcctgagctgcgcagtcggaaagctcgctgatagagcaacacgaggtttagcagacacgcattcggagagccaatacgctgcgtaatattgcgcgcgatattgcgcaatgggaggcggtgccgttttgttggactcatcgttgattccatcaccaccaatcatgtcacaagaccgagctcgcgtcgacgatccatgataccagttccacgatgccggtgtcgctatctttgcgatacacggcggtcagttcgccgcagctcacggtttccagtgtggcgcgcacgtcttcctttccggtactcgctcccgctgcgggagctgtctcgcatagcgagactgagggtggttctcagcgctgccccccagtcgggcgaagcccgccagcccccgccagcgggagcctgctcacagttagggttcgtacgatttgttcggtggtgcgggtcacgttggcggccgcatcggccaacagctcactaaggctgacggctccgggcgcgatgccgaataccgcgtcgatgccgacctcatgcagctcatcgatgccggtgccaatatgcccggctactgcgatgaccggcttgccgtggcgcttggcggtttcggccacgccggccggcgtcttgccgaacttggtctggaagtcgatggagccttcgccggtgaacaccacgtcagcccattgcgcggccgcatcgagtccggattgttcgatgacgatggcgatgcccgggcggaattcggcgtttaggaagcccttcagcgctgcaccgatgccaccggccgcgccggcacccggcacgtcgttcacggcaacgccgagctggctgtcgattacctgcgcaaaatgcgcgagggcggcgtccaatgtggcgacatcatctttggacgcacctttctgcgggccgaacacggcgctggcgccggtggggccggtcagcgggttggtcacgtcgcaggcggcggtgatggcgacgttcttgagagccgggtccatcgtgctgatatcgatggtggtcagattggcgagggccgctcccccgtgtgccaagtcgttaccgttcttgtccagaagacgaacgccgagggcctgcagaagtccggcaccggcgtcgttggtggcgctgccgccgagcccgacgatgatgcgcttggctccggaacggacggcggcgagcatgagttcgccggtgccgtaggaggaggcgatcaacgggttgcgttctttggcttcaagcagtgccagtccgctggcttcggctgtctcgaccacggcggtcgtgccgtcggcgagcagaccgaagtggccttcgacaggccggccgagcgggtcgtggaccggcacggcgcgcatcgatccgccggtggcgtcgacaagcgcgcgtgcggtgccttcaccgccgtcggccatgggaagacaacggacctcggcatcgtggtcggcattctcaatcccctgagccatcgcccgggccgcctccatggcggtcaggctctctttgaaggagtcaggggcgcataagtatcgcgtcatgcttcgagcataccgcacgacacgacgaaacggtaaacgttttccgtaattcgcgtgattatttttttgttcagaattcaggctttccaatccacaatgctactattgcaagcaaaaatgcgatatcgttgcggtaaacgtttagacacgttttccgtttcagggaagaaaaggatcgattcgatcgtggctgtacagaacgataaggcgcaatcgccagcgacattgatggatgtcgccaaagaagcccaagtctccatcgccaccgcatcccgcgtgctcaacggcagcacccgcaaggtacgcaaccaatcgtatgtcaaggtgatggaagcagccaccaagctcaactatcgtcccaacgcctatgctcaggcagtggccaaaggcaccgcaccgaacatcgtgctgctggtctccgatatctccgatccctacttcgcatccgtatcgcaaggcgtggtcaaggcggcggccgaacgcggcatttccgtgaccatcggcgtggcagccaccccgcacgaagagttggaggcggtgcgtaagtccgtatccaccaggccgcgcggcatcatcatctccgaaagtgaatacaccgacgcgccggaacgccaggcgttgcagacggaactcacccagtacgaagcatccggcggacgtgccgtgttcgtgctcaaccgcaacctgcccttcccggccgtggacgtggcgaacgatgtcggcgcgcgcgccatcgcaaagctgatcgtcgattccgggtatacgcgccctgcgattctcaagggcgatgacgcacatcgctcctccaaagaacgactggccggcgtgatggaagtgttggacgaggcaggcatcaccgtggatccgaaagccgtggcgaatggtaagttcagccgtaccgacggctatgcggccgtcatgcaaatggcccgatccggactgctgaagccgggcgaaggcgcactgtacgacggcaaaggcatcgattcaatcatcgcgctcaacgacgtgatggccatcggtgcgatgaccgcgttgcgcgccaacggcatcgagccgggtcgggaaatcggcgtcaccggtttcggcgacatcccctactccgccgacgtgtttccgccactgaccaccgtgcatctgccgctggccgaaatgggccaggccgccgtggacagcatcctgtccaaccgcgatgacggggaggccaccggcggcactgccaaccgcctgatctacgtgcaaagcgccccggacgtagtcctacgcggttccctcccccgccggtaaaacaaaaatagctccctctgacggtgtaaccacaactagcgaacaggtaatggcgactgccgcgcaccataccaccgactcatacaccgacgaaatcgaagaactgctcgattaccgcatcgttgagcaaccggccacgacgagtgggcaccactcgatgattatcggatacggtaatcaggccttcgctgaccattggggcgagttggtcaagggaaacattacggagagtctggggcgtgctgctcatacccgcatcgttgatggcgcggttgatgcggtcgaggtcaaggccctcgtgcaggcgcagcccgagcatgatgagctcttcgaggttttcctcgggagtgatcgtctcgctatcggcccacggcacacggttctcgttgatggccgtgccccacaaacgcgggtgcgcgatgtcccagctgcgcagaccgtgtgagacagaaaccacccccagtccggcatccgccggacaacccccgccagcgggggcatgaatttcttgggagttgttcccatgcgcgttgatcatacctagttcggcgttggcctgtccatcagctgaggcagaggcaatggcttcggacttgctcccgccagcgggggctgtcagcgaagctgactgggggtggtcagcctcggtcaccgcgttgtagtgggagtgggcacctggccccaggccggcccaatcgacgttgcgccagtagccgaggttgtgctgactttcgtatccggggcgggcccagttggagacctcataccattcgaggccggcggcggcgaacaggtcgtcagcgatctcgtatttagcggcctcgtcatcgtcattgggtttgggcaacgtgccggcggcaatctgacggcccattttcgtggtcggctccacggtcagtgcgtaggcggagatgtggttcacgccaagatcgatggcggtcgtaaccgaggtgcgccaatcgtccaggctctcccccggtgcaccgtaaatcagatccacgctggagcgcaggccggccttattggcggcattaacgcctgcggccacgttggccggcgtatgcgtgcggtcgagggttttgagcacgtgcggcacggcagattgcatgccgaaggaaacacgggtgaagccgccggcagcgagctcattgatgtaatactcgttgaccgtgtccggattggcttcggtagtgatttccgcgtcgggcgcgatgctccagatcttgcggacggcatcgagcatggcgaccagatcgcgggcggcgagaattgtgggggtgccgccgccgaagaacacggtggagaccggtggctccgcgatgccgtgatcgagctgccactgcttggtcaatttcatttcccgaatgaccatattggcatagttgccgcgcgaggcccccgcaccaagatccgtagccgtgtaggtgttgaagtcgcagtaaccgcagcgccgcaagcagaacgggacgtggatgtagacctcgaacactagccctcggtcttctgagcggcacgaatcttgtctttggtgtcgcggtcgttggagtcctcgccggtggacagggctgcgatgaacgcctcctgcggcacctccacatggccgagcatcttcatgcgcttcttgccagccttctgcttttcgagcaacttgcgcttacgggtgatgtcgccgccgtagcacttggcgagcacgtccttgcgtaacgcacgaatgttctcacgtgcgatgatgcgcgaaccaatcgcagcctgaatcggaatctcaaactgttggcgaggaatcagactacgcaatttcttggtcatcatcacaccgtacgaatacgccttatcgcggtgaacgatggcactgaacgcatcgaccttctcgccctgaataaggatgtccaccttgaccaaatcggcggactgctcgccatcctcatggtaatcaagggaagcgtagcccttggtgcgggacttgagctggtcgaagaagtcgaacacgatttccgccagcggaatgcggtagtgcatctcgacacgatcggtggagatgtactccatcgtgcccataatgccacggtggtcctggcacagatccatcaccgcaccgatgaattccttgggcgtgatgatgtcggcggcaaccatcggctcgacaatcttcttgattttgccgtccgggaattcgctcgggttggtcacatgatgctggctgccgtcctcggcggtcacgtcgtaggtgacgttcggggcggtctggatcaggtcgaggccgaactcgcgggagagtcgctcgttgacgatttccatgtgcagcagacccaggaagccgcagcggaagccgaagcctagggccacggaggtttccggcgtgtagatcagggcggcgtcgttgagcttgagcttgtcgagtgcatcacgcagttcggggaactgggcgttgtcgatcgggaacaaaccggcgtagaccatcggcttcgggtcgcgatagccgggcaacggctcggcggccgggcggacggccgaagtcagggtgtcgcccaccttggactgactcacatctttcgcaccggtgatgatgtagccgacctcgccggcaccgagtgccttggtgcgggtcatatcggggctgatcacgccgatttcaatgggatcgtgggtcatgccaatgcccatcatgtggaccttttcgcggtcgtgcagttcgccgtcctccatacggatgtaggtgacgatgccgcggtaggagtcgtagacggaatcgaagatcagcgcgcgggcgggggcatcggggtcgccgtgcggggcgggcacgtccatgacgatctggtcgagcaggtcggccacgccttcgccggttttgccggagacgcgcagcacgtcgctcggctcgcagccgatcagacctgcgatctcctcggcatgcttgtccggttctgcggacggcaggtcgattttgttgagcacggggatgatggccagatcatggtcgatggccatatacagattggacagggtctgcgcctcgatgccctgggtggcgtcgacgagcagcaccgcgccttcgcaggcggccagtgcgcgggacacctcataggtgaagtccacgtggccgggggtgtcgatcataccgagcgtgtattcggtgccgtcaaaggtccacggcacgcgcacggcctgggatttgatggtgatgccacgctcctgctcgatatccatacggtcgaggaagcgatcgcgcatctctcgctcgggcacaatgccgctcaactgcaagatgcggtcggccacggtcgacttgccgtggtcgatgtgtgcgatgatacagaagttgcgaatcaccgactgatccgtggaacccggctgattgtgttggacgaccaacgcattcctcctcttggcatatactcaaacttcacctagtgtagccgagggactgtattcggcgtggcattgcgcgggtttttccggggctcatgctatcctctaacttttgtatgtccttataacacacatcgtttggagtaaacgtggcaaacattaagtcgcagaagaagcgcgtgctcaccaatgagaaggcgcaccttcgcaacgtggctgtgaagtccggcctgaagaccgccatccgcgccacccgcgaagccatcgccgccggtgacaaggctgccgccgaggccgcctacaaggttgccgcccagaagctcgacaaggctgctggcgctggcgtgatccacaagaaccaggccgccaaccgcaagtccggcctcgctgttgcgatcaacgctctgtgagcataagcctcttaaggttttagaaagtcccgcaagtcatctggcttgcgggactttttgtatctccgttcaaagaggtacattggcggtcttgcgaaatggcctttcgctgtttggtgtgggtgggtctgtcaggtggtgacggtgctgaggtcccacactgcggaaaaacactgccgaacctgtcgaacaaacattgaagcaaaacactcgaaatccctggtgaaccggctgcccggttccgcccacggcacggaggcgaccacgacgccgcacctcgggcagtccacgcgcggcatggcggcgaccagttcgacgcgccagcagcccgaagtcctggccacgccagcggcgcactccgccgccctggtcatacccgcggtgcctccttccgcagcgggagcatctgagcgcgcccgcacgcgggcgcacgcggacctcgagcacgggctcgggacgcaacggcgagtcgacgatccgcacgtcctcgaccaccgtgcctttgacgttgagaagctggttgaatatgctgctcatcaggcgctttttggctgtgcttttcttggtcgttaaacagcctacccaaaaagcgctcttctcttactcccacaacggttcaacaacgaaccaccacccacgaaaacaacaacagcgccgttttttgatccctccctcagtcagcgcgactgacagctccctcacagagagagctcagtttttactgcttgttgatggaacaggcagcggtgtcagtggtgacaccggaatcagtccagcccattggagtttggtcgatggtgaggtcggagacggccttgatagaggtagtcacatcaaaggagtaggtaacggattctccagggccgatattggcgatgctggcatacacggtcttgccattcaaagtctcctgacgactaccagtcaccgtaccacctgaggtttgaagattcgtgaggctgcctcccgcaggagcgtagattaaggttttctctacgccacggccttgttgatcagcgtttacactgagaatatacgttccggcagctccagctatgccaatctggttatcgtctatcgtattcgtcatcgtatattccacatggtaggtctgagaaccatcattattgcaggcggaacgagttatcttcgacgtgcggtgaatataccaccccatctttgacgggttctgctcagtcacatacacacccgcctgcggatgttcctcactgctcggagtctgtgcagtgaagcctgcatcgctaatagtcttctcagtagcctcgtcaaacgaatacattgagaagcaacgaccttccgacatacttcccatcagttgcgctaccttgctcagcttcgtcaaatccaaattagagaacatgttactaactgtttgctcggcgacttgggcaaaataggtgtcctgcatgtaaaccggataatcgatatacaccttgtttaacaggaattcagcagtgttgcctccggcgagcacacggccatcagaaagcgtgatgttgccgttgattttcaccaattcctgcagaaacaccggatcaaccatgagcacaccatccaatggagtgtcacgtccccatgatgtgcgctgccagatagactgcataccttctgcaacacgagaggtatcaggatatacagccaaatcacggatatcgaacgacattttcagaggcccccactgctcgaaaatacgctgttcatcttccgttggatcaccagcaccatacgggatgcactctttgttcgagcggaaatccccaatactaatcttgccgttgtccgtagtcaccacacccacggaaccaatcaggccaccggatgagcgctcctccgaagtggtcatggccatcaacgcgtatgtacgcgcctggccagagccgagaaaattcggcggaatctggaatgtgccagatagctgatcaaccctatcggccaatttcgttaattgagtcttgccggtgttgtaggcatcgttgactatgccgatatgggccttcggcagattctgatatttctggacctgctgttgcagcgattcattggctgagacaatggtcttctgcgcctccagaatcggctgaatattcagctgcccatcccctgtgctcagttgcgcattcttcaaagtagtcagcacattcataaactgcggcgccgagtcgccaatcaatgaatccactaccgaagtcatgccctgcacggcggtaatgtcatcgccatacactggcagtttcgaggcaatgttccacagcgtgccatgcacaatatcgttcgccgcggcggtttcggtcttcgcttgatcgatctgctaactcaccttatcaacgttgtcgagattgctgagatcggatatgccacccaacaattgcaaagcctgctcctcatgagccttaacctgcttggcttcggaatacggtttcaatccgcagaatccacacacgcctaacagcaccacgagcaatgccagaatcgacaccacccatggccagacacggtgccttctgctcggaatacttactgcgtgccctgccctatgcctgctcataccaattcccaaaatgtctgagccaacttgcatatctatgcaatgaccaaccacctattatgccccggtctcttgcgaaaagtgggttcgctccccgcttctgcacatattccgaaccgactgggcacccccaggtataacgtattggggtgcttttgagaggctgcccggccaagcacatgaagagacggtcgccgaaaccatcgattgttgcgcgacatatgacgccgcatgaagaaccgacatgccaaccgacaccgcccaaagccatcaggccgagcaacggaagtggagtgtgtgcgtggctggagagagcggaatcaagaaccgtcgtggcgaactgcaacgagtgctgagccaagaggaatcgtacgttgacggcaagctgagtcatgccgcgtttatttcgatcgcaatcctgaccttcatcacctttgtcggcaactttacccagctgcaactgagctcggcgctgccgatcatcgtgtcggaattccatatttccgtgaccacaggccagtggctgacctccgtgttccagctggttatgggcgtcatggtaccgctgaccgcgttcctgacccgtcgtttctccacccgtcagatcgtgatctgctcgatggcggtgttcacggtcggctccctgcttgcctggctgggcccgaacttcctcttcgtgctgctcggccgcgtgctggaggcagccggcacgggcgtgatgtggccggtgctgcagatcacggtgttttccatctacccgctttcccgtcgtggctttgcgatgggcaccgtgggcatggccatgagcgtggctccggccatcggccccaccttgggcggctggcagaccgatgccaacggctggcgctcgatcttcctgaccatgaccatcattggcgtaatctcgctgctggcggccatgttcggactgcataatttcggttcacacgacccttcggcccgcgcggacttcttctcggtgtgcctgtcggtgatcggctttggtgggcttatgttcggcttcaccaattcagagacctatggattcgcggcaccggtcacgtgggggcccatggttgtgggactggtcggcattgtctggttcgtgctgcgtaacctgcgcgctggcaagcggtatcgcgaggccgcagccaaggacgagtcggcactcccccagccgccgctgctggacttggaagtgctgaagaaccgttcgttcaccgtcggcaccattaccgcgtcgctggcatttttcgcgttcagttcgattctggtcatcatgccgctctacatccagaccgaccgcggctattcggccacgatgagcggtctgatcatgctgccgggcgctatcggccagtgcgtctcccagttcttcggcggccgcgcgatggatcgattcggcgcgcgcccggtggctttgttcggttcgattgtgttgacccttggcaccttgggcatgtcgctggtggcgatggatacgtggatctggtgggtatcgatctgccagttcatccgtcagatcggcatgggtttcctgctgatgccgattaccacgtggtccctgaattgcctgaacgggccgagcgaagtgtccgccggatcatcggtgacgaataccgcgcgtcagattgcgggcgctgtgggcgcacccgtgttggtgattctgatggaaacgtttgccgctttgcataagcagggcggcgcctccgccgtcgccgcttcgatttttggcattcaatgggcgctgcgcatctccgcaatgatctgtctggcaatggtgttgatggtgttcttcggcgtcaagggcgacggtgccggtcgtacgcgagacattatttccttgcgcgcgctgcgcgaacggcgtgcgcggcgtatggctgcgaactgacggcagatccaaccattctcaacataataagaagccccggtttccaacaccggggcttcttattatgttgtgctatcgcaggatttcagctggagtctattacgccctacccatcagcgtcaggacaatcagcagcacgttgagcgccacaatcagtgccacgacgatcatgaaaatcacgtgcttgacggttccatcagcccacttgcccatgagttccttgttatgcgtgtatcgcatcagcggaatcacggcgaacgggatgccgatggaaagcaccacctggccgatgaccagcgcctgagtcgggtccttggcgaaccacagcacaatcagtgccggcaccagcgtgaccacacggcaggcccacatcggagcgttaacgtgcagcagaccgtgcatgatttccgagccggcatacgtgccgaccgatgtggagctcagcgacgaagccagcaggccgatggagaagatcgtgccgatcaccgggccaagcacctgcgtgatcgcccgctgtgcgccgtcgatggaatccgtgccagacatgccgtgcagcgagttggcggcgagcaccagcatcgccagattcacggtgccggccagcaacagcgcccaggccacatcgattttcgagcctttcagctgcgttttgatcgacggcttttcgccgcctgcgtaatggtcgttcaccagcgtggagtgcaggtagatggcgtgcggcatcacggtggcgcccagaatcgaggcggccatcagcaccgagtcggtgccctggaagcgtggaatcatgcccttgaccacttcgccggggctcggcgggtccacgaacaggcctgcgatgaagccgaatgtgataatcagcagcatcacgatgatgatgcgctcgaacgtggtttgcgtcttgccaccttggaaccacagcatcaccgtggaaattgcgccgatcaccagaccgccgatgaacagcggcaatccgaacagcaggttcagggcgatggcaccgccgatcacctcggccagatcggtggcgatggcgatgacctcggcctgcatgaagaacatgaagcggccggcatcgctcatacgttcacccagcagttccggcagggatttgttggtcacgatgccgagtttggcggactgatactggatgagcacgctcatggcgttggcgagcaccagcacccacaccaacaggtagccatatcgcgcgccggaggtgatgttggccgccacgttgccaggatcgacgtaggccacggccgccacgaacgcggggccgaggatgctggccagcgcatggtcatgcggctttttcttgccgtttgccacggttccagctccggctccgactccggcaagctggcgttccttctcgatttccggtgtttcctgttcgatgtctgccacggcgttcgtcatagtggttgccgcagtggcatctgctgcggtgtgtgttactgccatatcgtctgttcctattcccttctcccttcataccgggctcagttatagcgcgggcatgtttcccgcgtcaacagacggacaatctgcggacgattgatggatgactggcggactggcagctggcatttcccgccatctcgctcatgaaatgtgacaaaccgccgaaaactcgctcatgaaatgtgccagacggtagaaaactcgctcatgaaagtgtaaaatcattgatatagcagtaattcggaaaggggctcctcatgtatctcaaacgcaaagccgatgcctatctcaatgcatggaaatccgacccgaatcgctccccgctaatcatcaagggccctcgtcaagtaggcaagacagagactatcgattactttgccgcacacaactaccgttcggtagtggaaatcaacttcgttgaggaaccgaaatatcgtgcaatcactgcggacggttatggcgcggataccatcgtccgcaatatttccctgatcgacccagccaaaaagttcattccgggcgatacgctcatctttttcgacgaaatccaggcccatcctgatatcgccactgcactgaagttctttaaaatcgacggcaaatatgatgtgatttgcagcggttcaatgttgggcatcagctataagcaaatcgaaagcaatagcgtgggatataagaccgactacgaaatgcgatcgttggacttcgaagaatttctgtgggctcgcggatacgatgaggccgtcatcgaaagcatgttcacccacctgtgtgatgctacgccattctctgaagtggaaatgaacgtcttctccacggcatttatggattactgcgtgcttggcggcatgcctgcggttgtcgcctcccatatacgcactggcacgttcgagggaacactgcaattgcagcgccagcttattttggactaccaggaggatatccgcaaatacgcgcaaggacccgatcaggcacgaattctcaacgtgctcaaccatattcccgtgcaactcgccaaggaaaacaagaagttccaaatcagcaaggttgccagcggagcgcgtttcaaagactatcgaggatgcgtggaatggcttgaaacctcgggaatggtgaatatctgccgatgtatgtcctatcctgaactgccgttgaaaggcaattatgacgaaaacaagttcaagatatatttcggcgataccggtctgttcgtagcgatgcttgacgacgaggccagtgatgatctgcgggccaatcgtaatcttggtgtctataagggtgctatgtacgagagcatcgtctctgaagcgctacggaaatccggctatgacctgtactactacaaaaaagaggattccacactggaacaggatttcttcgtccgcacgcgcgaatggctggtgccggtggaggtgaaatcgaaaaaaggcaccgccaaatccatgcggacgctaatcgcttcggattcttatccggaaattcagttcggcgtgaaactatccgccggcaatatcggtagcagcgaacacgtgttcaccgcaccatacttcaccacatttttgctccgacggctcctgcgcgcttatgacgaggggcaggcacctatgctcaacaatcctgagcggtagcccctattcgtctgcgggcacggcctggcccgggcaggtgtggaggacggcgagcatggcgtccttttcttgggaggtgacggtgagccggtacttgtctttgacgccaatctggcgggccacgtagtcgcaacggtagtcggcgttggtgggtagccagtaggcggcggaagccgaacccttctcctgattggccgggccgtcgacggccagcaggttgtaggggtcattgccgaattcatggcgtttggcagtggaccagtcgcgcgcaccggattgccaagcgttttcaagggccaccacatggtcgatctgcactttggcgctggtggcgcggccacgtacaaaatggatggtctgagcggtgtacggatcggccagtgtgccggactcgaccacacaggaaccggcgtatttgtaggtgatgtccgtgagatcacgggcgagcacgtcgtcgcgtacgtcgcagccattgccgtcgacgtcggtggtgcggaaaccgaaggaatcgcggtcgtagccggaggagctttggttgtcgtctacggcgagcgcgttcaaagtgtcggcggctgaaccggtggcagtgtagccaccggtgattttggccgcgtcggagctgacctgcggcagtaacaggccgatggtcacgccgattgctacggcgagaacgatgagaatcagcacgcgctccagcggaccagaagcgttgaaacgacggcggaagtgggcgttacgacgtgccatcaatcacgcataggtgaaggtgagggggtcgtggccggcgcgggtggggccgtcgagggcgtcgatggcagcgtgttcatcggcggtcagggcgaagccgaacaggttgagattctccttctggcggtcagcatgcacggacttggggatgatgatcgtgccgttttcgatgtgccaacgcagaatcacctgggccgggctgacctcatgggcggcggcaatcttctcgatggtgccgtcgccggcgttgaggtcggcgccacgcgccatcggcgagtaggcctccacggcgatgccgtgctccttgcagaacgccaccacttcgcgctgctgccacgtggggtgcagctcaatctgattgacggccggccatgcgccggtctccccgtgcagacgcttcagatcggcgggcatgaagttgcatacgccgagcgtgcgtgccatgccttcgtcgcgcagcttgacgaacgccttccaggtgtcggtgctgcgccagtcgaacggcgtgggccaatggatcatgtacatgtccacgtaatcgagctggaggagttccagcgagttgtcgaaagctttgagcgcggaatcgtagccctgctcggagtcgcgcagcttggtggtgacccacagggtctcacgcttggcaccggtgttgtagccggaggcggcgagcgcgcggcccacgccggcctcgttgttgtatccggcggcgccatcgatgtggcggtatccggcttccagcgcggattcgacgacggggaccacgccctcgtcatcgatgcgtaggacgccgagaccgacttgcggaatggaatggccgtctttcaaggcgatgtccggcacgttggcggggttgatgtgtccgttggtcatggcttgtgatgctccttcatgtactgcaactacacgccactgtacacggttatgcaggcgatgtgcgggtgctgcaaccaaacggcatgattgcgcccggccttccgtgtgggagagccgggcgcaatcatgacaacatcacgctctactcctgcgaccggccctcgccctattgttcccgggcgcgaatttgccccggtacaggcgtcaatcgattgacgtttgcaccggggcagaaatcgttgtcccggtacgcaatttcgggccattttcgagaaccaggacaagacaatccccaaagtccacataccccgacaaacagaatcggcggaatacagccaatcccgaaatcaacatactgtcccggttctcacgtagaacgattgacgtgcaaaccggggcaacgggaattgtcccggtacgcgaaaaacacccgttttcgcaaaccaggacagtgatttctgtcctggtacccacatcaaacgattgatgcacgaaccgggacagaatcgcatcgctgcgccgagacagacgcgtctgacagccgacaaccgataaacgacagccgacagatggcatctggcatctggcagccggctgccggcaaccgcatcataatgccgcatcagtctctatcaggagcgcttacgacgcaaagcaagcgagaccccgccggccacgccgagaacgacaaccgcaagacccacggcagtcaccgcgctaccggtattgctcagcacaccagtgatcttgtcgccattcgcaccgttggtcttatcgccctcgcccgtatcgggattgatagtagccccgccattacccgcaccgtccgagccgttgccggaaccaccttcggcccgagcggtaaccgcaaccgtataggtttcggtgacattcggattcgacttgagcgttacggtaaccttcgccgcatcagcgggagcggagaaatcgtaatcgagcgtgaactggtcggcggaaagcgtcacgttgcccatgcctgcggaatagttgcccacgaccttgagatcatggtcggcatcgatggcatcgcccacctgataggtggttttgcttggcgtgacggtcaggctggagacctccttttgggcgaggccggcaatggcatcggcaacaagcttgatcacatcgttcacgtcctgctcggtgtaggtgctgccggcaagcagcacgtcagcggcggcaagcgcctgatcgagtttggcgagcgactcgttggtgtactcatcgcgattgattttcccggcttcggccacggccttgtccaggttctccgtggatggcttcaccggagtttcggtctttttgacgagtgagaccttgtccacattgccccatgcgtcggcaggcaggttgcccgtgatggtgatggtcgctgtgccatcagcacccacggtgacaggcacggtggcggtatcgaacttaacccaaccgttgagttccagcgcatcggacgtggtcttgccacccgttgtggcggagagggccacaccatcggtaatagcggcgttgtccgctgccgcgccttggctcatggcggtcagcacgtattcgccaggctcgagtccggtgatggtctgcgtggcggagaaactgtaggcatcggatgcccaaaacttcagcgcgcgcttgccgtcggcggcgttgccactgtcttcggtgatggacgcaccggtgccggcaatggtccagttcttatcgttctcagcgttctcgaagctgccgtccgttacgtaatccttggcgggagtggcggtgacggtgacggtgacggtcacgtcgtggccagcgttggtggtgccggtgatggtgtatgtgcctgcgccacgaatccagtcaagcgcagcggattgccaggtcacggtttcggtctcgtccaccccatcctgatagtgtgcggtcacctcactcggcaattgcgctttgatcgcgtcgatggaatccgagtcagtcgcggtaatctccactggatctatcttggtgaacacatgatcggtgacggcaccggtgtgaatgtacttgaacgtcggcagagaggcgagcgccttgccatcgaaatcgaacaaagcttggttatcgacacctgagccgccccagtacaggccggcgtcattgggatcgtattcgccggccgcttcagtggcccagccgccaccgtacttgttccacgtatccaccagttcggcgttatccttgccgccggtgcccacgggcacccatgcgggctcccagtagaacacacccaggccgtcgttttcgccatcgccatcattgtcgccgatattgttcacggcctcggcgaccgcgcgaatctcatcggcctggccttgcgggctgatgtcgtatttcttgaggttatcggcggttactttactgggcactgtgttggaatcgtcgtcgccatcatccaaggtgtatgcccacgacgtttccgccaccatcacatctttcttataagtggaggccacgttcttgagcacgctggtgaggttttcggtggtgccatgccagaacgggtagtaggagctggcgaacacatcgtaatccacattgtggttgctcaactgtttggcgtaagtggcgtaggtgccggctttctccgggttggtgaaatgaatgacgaccttggcttcggggagcacttcgcgtatggctttggaacctgcggagaatactttggacatgccgtcccagccggagatgccggcgattttcgcagtggtttcgttgccgacctgcaccatgccgacgtccacgccggcttgtttgaacgtggtcagagtctgcttggtgtagtcgtatacggtgtcggcggttttgtccgcgtcgccttcaaaggatttccacgccttgggcacctgctgcttgctggggtcggcccagaaatcggagtaatggaagtcgaccagcactttcagccctgctgccgtggctcgcttggccatggtcagtgcgcgatcggcgttgacgttgccgccgccatatccttggccgtctgcggtgaacggatcgttccacacacgcagacgcacatagttcacgccggattccttgagcaacgtgaacaaatcctcgacctcgccattggcgttcttgaacgtgacgccgctttcttccagcgagagcatggatgagacgtccataccgccgatgaaatcatcgcttaagccttggatggccttgaccgagacgtcggctttaactggttcttcttcggcggcgtttacagtgaacgtgcctcctgcgcagagcattatggcggccacgccggatgccataatgcgagtaagcgcggtatttcggcgcatgctttttctcctttgaatggtgaacgctcagaacgaacgcccagtgatgcttggcgcttcctttccttatgcgccacgcggtacagctgtgtaccacgcaatcgccaccttagcactttatgccgtgttggtcaaccggtgtatcaacgcctcgtacggcccagtacagcaacaccagcattacagcaatgtcgttcagcgtgtggaggcgcgggcgatgacctgggattcggtggtgagcagttcggacttggtgatgctgccgtcgatgcgtccgaggatgcgatccactgccgtgggagccgtccagtcaaggcgggaatccatggtggtcagcggaatctgcaggtagggggcttcctcgttgttatcgaagccgatgacctgcacctgcacgggcacctcataaccagcggtgcgcagagcggtcaatgcgccgatggccaactgatcgttcaaggcaatcacaccgtcgaatggcacgccggaatcaatgagccgctgggtcacacgggcaccggctccgatggtccaatcctgatcggtgttgccaatcagctgcggatccaaggagagcccacgcctacgggtctcttcgatgatgccgcgcagacgcagctgcgcgttgccttctacggcattcagcaatgcatcttcgtcgtaaacgtcacgggcaccgatcactgcaagtctggtggaaccgcggtcatacaggtagcctgcggccatggcggctgcggatacatcgtctggggtcacgtgatccacaatgccccacgtggtacgcgcgccaacgatgaccagcggaaaatcaaccttcagatcatcgggcgaaatgttttccacctcgctcatggaaaggatcatgccatcggacaccgtggagttgaacttcttcagcagatcgcgcgcgcctttcgcggagccttccgcatacgtggtgacgtatacggaatagtcgcgctgacgggcggcctcgatggtgcggttggcgagctcggccagatatggcggaatcagcgaaggcacggcgagggtgatgaagccggtgtgatcgcggttgaggttgcgggcggccacgttgactcggtagtcgaggtccttaatgaccgactcgaccttggcacgggtctcatctgtcatacgcccggagccattgatcacgttcgacgcagttttgagcgatacaccggcggcctgagcgacatcgcgtagcgtcactcgacgcttggctgttttctcgtcgctcatgccgcactcctctatccggacaacattgccattctagcgcggtttagcaggacgttttagcgataagaatggcgttgcggttcagcgtatatccaacggcgtcagtctcgcaacggtgggcgatgatgggatcaccttccacaccgttgatggcgacgggctggtttgagcggttgaggtagaaatcgaagcgggtggagccgtctgcggatcggcggatggtgtgcaggatgcggggatctgtggtgggataggttggagtttgaccactctcagtcggctgcgccgacaactcctgccatcgggagccaagtgctttgagcaactgggcaatgtcgtgacggttgaggtcgcagcccacgtagatggcggtaccgttgccataggggcggctggtgatggcgggggtgcgctccagctcccagtcggcggcggacttacctgcgtaagaggcaagcactgtggtgtccgcggctacggaagtcacgtcgttctgccacaggcgggtcgtcagaccattggacaggctgatttcgctgggctcgccttcggcttcttcaccgaggatgttgaattcttcggagcggatgccgagcatgtcgcgtaggagcccgttgccggcgccggggtagccgccgaggccgatgtggaagtgctcgtcgatcaggccggcggcatagccgacgatgacggttccgccggccttcgcgaagtcggcgatacggagaacgtcttcgtcggacaggctgagcacggtgggcagcacgatggttttgtagccggtccagtcgtaggcgagcggcaccacgtccgcgcgcagcccggcatccaggaagccgcggtaccagtcgcgcacgtcgtgccagtggttgagtttcatgctgggcagggtttcggagcgtgtggcccattcggattccgcgctgaacaggatcgccgtgccggcacgctcgagctcagtgccctgcagcccggcgtcggagagggtcttcagcgccttaccgagctcgcatacgccgcggaagaccttggaatcggcacccgcgtggggcagcatggcggagtggaacgcctcggcgcccgacttggattgccgccattggaaaaagcagatggcgtcggcgcccatggccacgtgggccagggagtcgcgcatgagttcgccggcccgtttgcgtgtgttcagcggcttccactgcacggctgaggtggagtgctccatcacgtaccacggcttgcccagcgcgagggagtccatgagcgcgtccgagcaggcgagttcgtccaggtgggattcgccctcatggaagtagtgatcgttggacacgaagtccacctcatccgcccatttggcgtagttcatgacgcactggtcggtggagaccatgaagttcgtggtgaacggcttgtcggggcagatctgctcgatggcgtcgcgttcggctttgtagaagtcgagcagcatgtcgttgccgaaccgctcgtaatccaactgctgcgacgggttgaccatggcgtcgccgcccatgtgacgtggcagcagcacctcgtcgaaactgttcacgtgctgcgaccagaaggccgtgccccacgcctcgttcaacgcgtcgatggtaccgtacttggcctcgcaccacgtgcggaacgcggccaaggcgttgtcggagtagtcgtagcggttgttccagccgtattcgttgcccatgtgccaggcggtcacatacgggttgtccttgtagtgttcggcaagtctgcggcacaggcgcagcgcgtattccttgaacaccgggcttgttggctgccacgactggcgtgagcccgcgttgacggtatgaccataccggtctaccggcagcacctctggatgggattcgtacagccacagcggcgcggcggctgtggcggaggccaagtccacggcgatgccggctctgccgagcctgtcgatcacatggtcgagccactcgaacgtgaacgcgccctcgaccggctcgatcttgtcccagctgaaaattgccagcgatacgacgttcacgccggcctcacccatgagacggatatcctcgtccagcgtctcctcgggccactggtccgggttgtagtcgccgccgaacgcgatgccgcggccggattccgtcagcagggacggccacctaaatgctctatgagtagtcatattaatcaaatcctttattgtatcggtttgcgggaagtgctgtgcttgcaggttgtgaacaccagagaggccgcccccgctggcggggctgtcagcgaagctgactgggggtggtcgccagtcgaatccccatatgaccaccctcagtccgctccgcggccagctcccgtcagagggagccagaggttactccttgacggcgcctgcggcgaggcctgactgccagtacttctgcaggcacaggaacgcaatcaccagagggatgatcgtgatcagcgaaccggtaatcacgaggttttggatagcttgaccgcctgcggttgaagcctggtccttccactggttcagaccgatcgtcaacgggtaccagttggaatccttcaacatgatcaacggcaggaagtagttgttccacgtcgctacaatggcgaacaatgcagtggtcacgatgccgggtgccaacagcggcagggaaatctggaagaaggtgcggaactcgccggcaccatccacgcgcgcggcttcaagcagctcatccggcacggcctgatcggagaagatccacatcagatacagaccgaacgtggataccaaactcgggataatcatcgaccacggggtgttcgtgaggcccatcttggcgaacagcaggaactgcggcacggccagcgcgatacccggcaccgaaatggcgccgatgatgatcacgaagcacagcttacggccggggaagcggaacttggccagcgcatagccgcccatgatggccagcaaggtggcaccgccggcgccgaccaccacatacagaatcgtgttgacgaaccagcggccgaagataccgtcctgataggtgaacaccgtggcgatgttgtcgaacagggcgaacgttttgccgaaaccgaggccgaacgtcgaagtgaagtcggactgggtcttggtggcgttaatcatcaggtagacaaacgggaagaggcagtagaccgcgaaaatcgcgcacacgatggtcagggccatcgagcgggtcgggttcgccgggttggagaaaccggttttggcggcgcgcttgcgctcggccttctcgtcggcgtcgatgcgcttctgacgctccttctcggccttcttggcggccttttcctgagccttgagatcggccagggtcatggttgttgttgaagtcatggttgcagtgctcataattacttcatctgctccttcatactcttaagctggacgacatacgcaatggccatggtgatgatggccatcacgatggccagagctgcggcatagttgctctgattgccggtgaagctcaggttgtaggcgtacatgttcggcgtgtagtacgtggtgatcgcgttgcccggaaccatgttctgcaaaatgctcggctcgttgaacagctggaagctgccgatgatcgagaagatcaccgtgatggccagcgagcccttcagctccggcagcttgatcttcttaacaatctgccactccgaagcgccgtcgatggaggcggcctcatacaagctgtgtggaatggtgcttagggagctgtaaaaaatcagcatgttgtagccggcatattcccacgtgttgatgttcgcgatggatgcaagcagcacgtcggggttgagcacatcgatgttggtgccgaggaagtcgttgagggagccgaccagaccgtatttggcgccatacacgaaaccccaaatcatggtggagaccactgcgggcaccgcatagggcaggaatgtggagatgcggaagaacttggtgccatgcagcttcatcgaatccaaagcgagggccatggctgcggccagaaacagcatgatcggcacctggaatacggtgaagatagtgacgcggcccaccgagctccagaactgcggatcctgaatcagtcgggcgtagttctcgaagccgacgaacttggtgccgccgaccatctgcttcttgaagaaggagatgtaaatggcgtacacaattgggatgatgaacacgaagacgaacaccacggcgaacggccacatgaacttccagccgcgccagtcggccttgtgcttgttgacgcgggcctcggccgtgtgcagatccgcctcctcaggcaggattcccaccgttggctgcggggctgcggccattgtttgatcggacataatcgattgctttcttggaatacggattgctgtgctgcgcccgctaccagggggtcgctcgattggagcggtcacgtcaggcgagggcacgggaaagcggggacactggggagcatccccgctttgggagatcgggcggctaggcggaaggagagtggcctagccgcaggttttgattgttggtcagtgccggatgtaccggcaatagatcggttgcgtcacttgacggtgacgttgtagccctgctgcttgccttgctcggcgagcttgttggcatagttttcaagcgccttctccagggtgatgtcgccggagtaggccttggagacttcgtcgccgtaagcggtctgggcgtacgggttgtacggcaggtactggaacttctcggtcgggcgctgagccgcggcggaaaggacttcgttgacgttctgaccgccgaagtagtcgttggtcttcttgttggactcggtggtcgggtcggtgaaggagtcggaccggaggatcttcttcagggacgggaaggtaccggtgtcggccatggtctgagcgccctcgccatgagtcatgtactcaacgagcttgtaggcagcggcctggttcttggactgcgaggtgacggcaagtgcagagccaccgtcttcggcggagacttccttgccttcctcccactgcggcagctgggcgacgcgccagttgccggcctgatcgggggcgccggtcatgaggttgatcggcatccaagcgccgatggtcagggaggcgagggtgccatcgttgagctcgcggttccaatcgtcggaccagttcggggtcttggcgtccacgaggtcttcgtcgatgagcttctggacgaattggatatagcgctgcatgccctcgtccttggtcatgttgatggtgatgttctcgccatcgaccttccacggctgggcaccggcctgccagatctgggcggtgaacggctgatagtcgttggaggtaccggccagattggtgatgtaggagccggtggcacggatcttcttggcggcctcgtagtagtcgttccaggtcttgatggactcgccgtccacgccggccttgtcgaacactgccttgttgtagaagaacatttcggggccggaatcaatcggcagagcgtacggcttgttgttgtactggagcttgttccacgggccggcggcgaagtcgtcggcgagtttgtcggcgccgaattcgctcaggtccacgaggccatcggtgacggcgaactgggtgacggtcggatcttcgagcatcacgacgtcaggggcgccgttgcctgcggcgatggcgttggagagcgcggtggaggtcttctcggcggtgccggtgttgttgaacttgacggcgatgccggggttggccttctcgaagtcagcgaggatttccttcatcgagttgccggaatcccagccccagaacacgagttcggccttgtcagcgtcacccttgttggcgccgttgtcgttgctgctgccgcaggcggcgagaccgacgagcgtggccacggctgccgttgccgcgatgaccttcttggtgttgcgcatgttatctccttctggaccattggagttgacttgcgggtggttggctttcttccgactggcttccggttttcgtccggttacttctcggttatcttccggctgtctttggctgccttccgattgttgacgactgccttccgattgccaaaaacgaatcgactgctgcgttggatttcaattcgtttggccgcttgcgaagtctcctctggtcacctttccttggggtgttttctttggtacacccgtgtaccaatacctaagatgatacacctgtgtaccaatttgtcaaatcacccgacacgcctgatttttttcgccttttccatgctttccacgtgagcaaatctccagtcgaacagcgacttgtctcagaggctcttcatcccctccccaacgtgagtaggtcccgactctcagcacaccaccaaataacgcgcagcatgctcgtgagtccccaacacccacacaccacggcgcgattccaccactcagccgcctcaccagtgcccacatttgtagatattcaacgccatatgacaagaatctgactagtatgaacacgcccccccatagctgtattgagaggaaaagcacatggcgggcctgtttcaagctacttccaagcagcgcaatcccttgggaacaaccatacgtactcacggatcgggcaaatatacgttcggtccggccttaagcgccggtcaatatccgcggtctgcttgccttttcctatcagctcctcgcggtatgcggcatcttcctgaccaatgtcatcaactacatcatcgcctcctacggtcccagaagctgggatgtcaacgccggttggcgttggatgctgaggctgggtgcgattccggccgccgcgttcctgctctccatggtgcgagcaccggaaagcccacgattcctcattcaagccggcaaaaccgaagagggattcgcggtgctcgagcacatcatcggcaccgaacaggcacgccttcgcactgacgacatccatgcatcggtcaaactcgaaaccgaaatgtcgcatgaatctcacgacctgttccgcccggggctgcggaaggcgctcatcatcggcactttgatcaaggcgtgaatgctgcgttgcgttactgcattgccatgttgccatgttgccgcgttattgcatcgctacgttgtcacgttgccgcgttattgcatcgctacgttgccacgttgccacatcacattgcattgccgcattgctgcgttgccgcatcacatatcgcaacacaaacgcagcaacgcaatgacgaccggagatggcatcgccgccaccagcgaggaaccgcaatgcaacgcggtaacgtaacgcaatgcgatgtgattcccgcgtagttacaggcagttacagattgagtaccgcatcagcaatgcgcatggcggattcgcggtgggagaccagcaccacagccgcgccgcgctccttgtctgcatgctgctcacccacggccatagcgtgaatggaacgtagaataatagcctcgttcaaagcatccaaacggctggtcggctcgtcgaaaagcaccagatcagcattgcgcaggaacacacgagccaaaccgatacgctggcgttcaccttcggatagacggtcgcccagctcgcctacctgagtatcaaggccatcgggcaaggaatcgatgagatcaagcacggaggccttggcgagagcctgacgcaaacgagcatcgagaccgtcagctgctgccacctgaacggcatcgccctctgccgattgcgccgccaaccgctgctgtcgggaatcaacggtcttggcacccacttccccattgcctgcaacatttgcagcttcaacctcggactcagacaaagcaatcagcagattgtctcggatagagccatcaaacaggtgggtttcctggctcatcatggcctgaatacgtcggcgagcatgcacatcgacctcgggcagcggcgtgccggacaacgtcacctgaccgcgctgcggatcccagtagcgcagcagcagcttgagcatggtggacttgccccggccggacggcccctggatacccagcacgccatgctgcggcacgtcaagcgagaagtcggacaggacttcgcgctcccccgcatatgcaaaggtgacgtcatcaagacgcatgcccatatactcctgcggcacaacagtgccattctcggtcacagcgggcacctcgtccatcagtccgaacagtcggctagcggacgcgaaggtctgagtcaggttagcgggcaaggcggcgagcgccaaagtcggtccgaacgagccggcgaacagcacgaaggcggcaatcagagccggaatgctctgcgggttcgcgccggcacaggcaatagccacggcgaccgaagccgctgtgagcacagccaccaagagtccgctgattccggtgaaacggccgttgaccttgctgagtttggcgtgatccttccacaacgcatgggtacggtcctcgatggcctgcgcacgttcctcgccgcggccaaatcggatgatttcgtccaggccgcgcatgtcatcaagtatcacatcgtcgagttctccggcagcgccacggatggcagggccaaggttacgtacgccggtggcaaagaatcgcggcacaaggatgccgataaccaggtgggcggcaatcaacgccagcgccatccatgggcttagggcggcggccacaatcgtgtagatgatggtggaggttaccgcgatggccaccggactgatggtgtgggcaaagaagatctcaagcagttccacatcggtggtcagcatggcgataaggttgcccttacctttgcccgcgagcttggccggcgccagtctgcgcaacgcggcgaacgccttggaacggaagagtgcgagcagatggaatgccacattgtggttcagatattgttcaatgtatcgggtgatgccacgcagaagagcacagataatcatcatgatgacggcgggcgcaacacccatgccccacaccggattaccggtaagtgcaaatgccgcgataatgccgaacacgggcaggaaagtggccgaaagatggccgatggtgccggcggtggaggccgctgccatcagtcctgccagaggtcgggcttccttaagcagtcgcctgatcacttggaatgtgctcattttggaagacgaatcgctatttgcaacaccagccggagtctcagccgaggcctgctcactcccgccaacggaagccgtcggcaaagctgactgcaggcggtcaaccgtcatacccgcctctgcgcttacgcgcgctgcgccaccctcagtccgactgtcgtcggacagctcctgcttgcgggaaccaacctgcagcacacgccgagcatggccttctccgaagttctcaatatctgcctgcgtggtaaacagcttggcgtagacgccgtccgccgtcatcagctcggtatgggcgccactctcaaccgacttgccgtgttcgagcaccaccacttggtcagcgtgttcggcgttggccatgcgatgggtgatcataataaccgtcttgccgcgggattgcgccaattcgcgaattgtatccaggatcagctcttcggattccatgtcaacactgctggtcgcctcatcgaacacaaataccggcgaatcatgcaggagcgcgcgggcgatggcgatgcgctggcgttggccgccggacaggttggcggcatcggactcaatcggcatgcccagtccgttcggctgtgcgtgcacgaagtcggcaatgcgcgcctgctcgagcgcggaccacagacgggagtccacggaatccggcgaatcaggaatctcgtcatcgggcaaggccatcagaagattctcgcgcaatgcgcccgcaaacagatggctgctggcaccaatcacagtgacggctccggccagtgtttcgcctgacaaatcggatacctcgacgccgttcagcgtgagcgaacctcggtaaccggccagtgtaccggcgagcagcgaggcggccgtggacttgccggaaccggagatgccaacaatggcggtgaactgaccgggccgtgcggcgaaggtgatgttggtgagcgcaggagcgacggcggaattggggctggtttcaccttgcttatcggcctttgcggatgcggacttggagtcgccgtgcccggcatcatcataggaatagccgacgtggtcgaagcggaccgtcagaccgtcgtcagcggaatcggaatcgttggccggcagggtcgccgtgccatgcttgggctccggggtgtccagcagagcgaagatgcgcttggtggaggtcatgccgttcatcgccacgtggaagaacgagccaagctgacgcatgggaataaagaattcggcggacagcagcacaatgaacagcagaccggtaagagacagcgggtagcccaccccgaacgggatgagatagtgcaggccgtatgccgcgtaggcaagcacaccaggcagatgtgaggccagtgcgattggcgaccagccggacgcaccattggcaaaagcatcgccaatatgcgcgtattgccataacgccacaccgatgccggccgcagcaccgccgtaggccactatgtccatggcggtcagcgaacgcaactgaatctgcaacacccgcatggtcatcacgcggaagccttcggctttcttgtccatctcgatggcggcgcgctcgtcggcgtcgaagtttttcagggtctcaaggccttggagattgtcgaggaacgcggcgcccatgtcggtgtagcgcacccagtactttttgaaggcgcgggcggcggtcatggagacgatgccggtcacgacgatgatgagcggcgcgcagaccagcatgacggcagcagcgggcacgttaatcggcgcaatggccacaaacaaggtgattggcgcaagaatcgcatagaagagctgcggcaggaacagttcaaagaagctttgaatctgttcaacaccttcgccggcggattgcaccacatccgaggtcttgatgcgggttttgtaagacgggccgagtgccaccattttgcggtacagcttggatcgcaaagccagtttgacccgctcggcggcttcggtgccgaagcgggtggcatgcgtggtggccatgtaccgaaccattatgcagaccagagcaagcagcacgtaaatcatgacatcgccggccatgggcagcacatccatgccgtgctgatcagacaacggcacggggcaggccgcgccttgcgaagtgccgccgcattggagcagcggcggtgccacagcggtcagcatgctgttcagcagcattaccagcgacaacataaaaccaatgttggcaagcagacctacccacatcagggccactttgccggctatgagtttttccaagccaggcgccaattggaacagtcgtttgtcgaacatggtccgcttccccttgccgtgttgttgcggtgtgccctcgtcatgtgtacctgcgctccacattccgcgcaatcccattcaccttaagcgaacgccctcgcacacgccagacttttaaagtgagagaggccacagaattatcgattgcggagtgcgcatgctagacgcgccaaccagaaaaaatatgcttcgatatcaggggctgaagcatccactacacccaatacgtgcatttatccgtttcgaggaggctaatttttgcgtttgccggaggcctacttccgtttcaaggggctgatttcgcatttgccggaagtctatctccgcttcgaggggctcctcatccatgtaatcggaagtataaacggctacacgtcaacgtcattccgccgttttagggccgtgtctacttgggcatcagcccctcgaagtggaagtagacttccagataaggcaaaatcagcccctcgaagccgagaaagcacgtttctacggtgtcagaagccgacggaacgcaaaagggtcgtctgcacgcagacgacccatatgatcaattcgccaatagacgcagcaaacgcggcctagtgctgctttttgcgcggcgaccagtgcttcggcggcggccgtacttgtcctgcaggaagtcgatggctcccgaaatggacacggtgtcataaccgtagagcaaaccggttagacacggcgttgtatacaatccacaaaaccagacagacaacttctccattgcccacaacgcgcgcaaccttacgccagcgtaacctaacttgtcagaatggctcgattttgtcaacagccatcacgcaacgcacgtaaggacacggcccgcttatgcttgaccactacaccacgcctggcgaatccatcgaaatccgcgacaaccagaccatctactccctacttaccgatcgccttgcccgcaccggcgcggacacggtaatcgccgccaagaaaatcggccccggccgctggcagaacgtcaccaccggcgaattccacgagcgcgtggtctcggccgccaagggcctgatcgcgctcggcatcgccaagggcgacgcggtgaccatcttttcctccacccgtctggaatggggcattctcgatttcgcactggccgcggtgggcgcggtaagcgtgccgatctatgacaccgactccgccccgcaggcccagcgcatcatgaacgattcggtggtcaagctggcctttgccgacaatcgcgagcgcttcgaccggctcgactcggtcaaggaccactgccctgccttgaagcagattctcatgatcgagggcaacgcgctgggcgctttggaaggcctaggcgtgaccgtttcggacgaggaactgaacgagcgcgtggccaccgtgcgcgccgacgatctggccaccatcgtctacacctcgggctccaccggcaacccgaagggtgccgaactgacccataagaacttcgtgtccatcaccatcaccgcttcgcaggcgcttcatgaagtggtgcttgacgaccatccacgcctgctgctcttcctgccgctggcccactgcttcgcacgattcatccagtacgcctccatcgcctccgatgacggcgtggtcggttatctgccggataccaagtccctgctgccggacctgcgttcgtttgaaccgacctacctgctgggcgtgccgcgcgtgttcgagaaggtgtacaacgccgcctcgcataaggccggtgccggctggaagggccgcctgtttgtcaaagccgccgaggccgcgcgcgtctggagccgcaaggagcaggccggcgagcaacacacatttgccgaaatcgccgagcgcgccaagtacgaaacgctcgtctaccgcacggtgcgcggcgctctgggcccgaagatcaagtacgtggcctgcggcggcgcaccgctgtcgctcgatctagcgcatttctacaacggcatcggtctgccgatgattcagggttacggcatgaccgaaaccgccgccccgttcgccgccacgcgcgtgaccgacaatgtgatcggcaccgtaggccagcccgcgcccggctcctcgattcgcatttccgacgaaggcgaactgcaggtcaagggcccgaacgtgttccgcggctaccacaatctgccggagaagacggccgaggcgttcaccgccgacggctggctcaggaccggcgacttggccgagatcgatgatgagggccacatcgtcatcaccggccgcatcaaggacattattattactgccggcggcaagaacgtctcccccattccgctggaggaagagatcgccaagtgcccgatcgtggagcactgcgtggtggtgggcgaccagcgcccgttcatcggcgcgttggtgacgctcgatccggagtcgctggcattgtggctgcccgcgcacggcctgtccacggagacgccggtcgaccggctcgccacgaacgccgcggtgcgcgaggagattcagcagtacgtggacaaggcgaatgcgacggtctcgcgcgccgaatccgtacgcaagttcgccgtgctggacacgcagttcacgcaggagaacaagtgcctgacaccgtcgctgaaagtggtgcgcccggccgtcaatcgcgtgttcgccgatgtgatcgacaacgagatctacaacggcaagcggtgagacgcgcggttcgtaatccgacacaaaaaaagggccttttgaaccgcaccccgattgttggactggagtaatccagattcgatgatcggaggtgcggtttctcatgtccagggatcgcaggcgtcattatgacgatgattccatgcgggtcgtcgccggggtgccgcccggcccaggtgggtcatgcccgggtcagtttcttgctcctgagacgcagcacgacatcggcggagttggcgacgcgcttggaatgcgtcaccacgatcacgcatttgccgagctgatgggcggcgtgctgcagcagatgaatcacctcgtcggtcatctccgggtcgaggctgcccgtcggctcgtccgcgaggatcgcgcggcccggggcgaccagcgcgcggccgaccgccacccgttgacgctggccgcccgacaggtgcatgatgttgcgcttggattcctcacggctcaaacccagttcctcgaggatcttcatatcggccttggcgctgaccagccgcaggttctcttcgggggtgaggtagtcgatcaggttatggtcctggaacaccagggacacgtgctcccgacggtgcttcgcatagcccgatgcggcgatgtcctccccctcgaagcggaccactccccgggagggggcgtccaggccggccagcagagacagcagcgtgctcttgccggcgccggacgggccggtgatcgcatacatcttcccggattcgaaatccgcgctgacatccgagagaacaaggatcttcgccgcgccgtaggcgtaatcgacatggtccagttgcagacagttagacatgattggtgactcctaacgcatagaggaaagaatggatttcggggatttggacagcacggcggcgcatgacacggcaagggccacggcgatgaccgcgcatccgagcagcaggatgagcaccgtctgctcaggcggcaaggcctccacgtgcaacgattccaatggcgcgacgcccgaatcgcgcaacagtcgggaagacacgtatcccgacagcatggcgccggtgcccagcgaacacagggcggcgaccgccgccatgagtccggtttcgatggcgagttgtgcgactatccgcatcttgtcgatgccgagggccagaagcgtgcctatctcatggatgcgtgagcgaatccagaagaccagcgccatcgccagcaccagtacgtccgcgaggcagacggacagcagcaccatgcgcaccagatcacgcaccgtctgcacggattgcaggacgccggagagccgggccgaatcgtcggtgacgtcgtacttgccaccggccatggtcttggcctgactgaccgccgcggacaggtcctgcggattatccgacaggcatcggatcatgccgatccggtcgtttccggtcagagcggaggtcactcgcctgcccgaatagatgaggttctcggaagtgtccgagggcagggggctttgggcctgcacgttgccggagaagatcccggccacacgcaccgtggcgttgcgcccctcctgccggagacggaatgtcgagccgaccgataggccgttctgcagcgcgaagtcgcggtggaccagcacatcgtcgccgtcgcccgagatatggcggccctgctccaggcggtacaggccgctctggaattcctctgacaatgaggaatcggtggtgcccagcacgctgacctgcatgcccagatcggagtccagccgggggccctgccggggcatgaccgggcgcgcgccatccacctgcgccaaggtcttcgtcgcataggcggtcttcgtcacaccggggatacgcgagaaccggctcgcctcctcggcgctgatgggattctcgccggcgctgacggtaaaccctatgcccatgcccgcgccgatgctgtcggacatggtacgcagggccgtcgagactccgacctgcgccaccaggctcgtgaagaccatcagcatcagcagaccgatgatgccgctacgtaccggcttgcgtacgatcgccaacgtggcacgcttccacacattcatgctcatcatcgaatctccgacaggtctcgcggcgatttgcgcagcatcggcatgcacgccaccgcgacgcacaccagcatcaccgccaacaatccgagcgccacgtacagcatggcggtcccgtcgaccgacaccgtgagcgaatccagggtgcgcaccgacatgctggattcaagatcgccgccgacctgccccatgctgctcagctccttcgccgcggaggcgttcacggaatggagcgccgtggcgccgagccattgggccattccctgcgcgcacagccagccgagggcgagggacggcagaccgatcagcaccatctcggcgaggtattgggcgaccagggagggcttgccgacgccaagggacaccagtatgcccatctcttgacggcggtcgttcatccacagcagcagcatgagactgagcacgagcacggccgagacggtcacgccgatcagggcgccgcgcatcatggagcgcacgccgcaggcggcatgcagcatactcgatgaatactggtcgttgcgcgtgatctgatagttgttccaatccaccgggagtttcttcgcggcatccatggtcttctccacgtcaacgcccttggacagcacgaaggtggcgtcctggtatatttccttgccgtccttgtactggtacaggtcgcgtgtggtatccagatcggtgtagatggtgttggcggtgagttccgctcggctggatacctttctggcgctgtcgcccttgaatatgcccacgatggtggtcttgacggtcgccgtcgaatgtgattcgttgtcggcgtcataggcgttggccttgagcgtgagcgtgtctccgactttgagcccgttggctttggcgagatcctcatggatcatcgacgtgtacttgtcggaggccttcagatgtcgtccttcggccatgccgagcgtgcgcgacgtgaacacgttgagtttcgacgaatcattcgtgcccatgacgttggcggcgttgccaaactgctgctcctgggtcgcatcgtaatcatcgccgccggggaccttcgccacattcgcccccacgagatcggcggtggcgttctgacggaccatatacgaatcgaccccgggcagttgggcgatcctgcgcacgtcggcggggcgcaccatgccgcctccgcgaggcgtgagcatgctgccctgcatgttgctggacagcacgaatccaccgaccgcttccttctcgattcgtccggcggcctgttgagctgcccgagaaaccgcgatcgtggatagcatgctcgccgttatgatggtcagtattataaggagcactatggttcgcactcgttttctgagcacatagcgcaccgaccgtgcaacgaacgtcatcaatacctcctgtgggacttgggcttttcgcccaaaatgcgaaacatgccgcgtttcgccgattagttagccgcgacgatacatgatgcacctcaagatacgggagatatacgccttgagcgaaaaacggaacagcggcgaatgtcggttattctggattttggtccatctcgggccgcgtcgatgcgtcggcccgcgagaaatcaggctcgcgcctcaccttcgaggcggcgaacacaagaagcggcagagcggcgaacgcatagttctcgcattggatgtacaggtatgcgaccaggacgagccagcagatgacggtcttgtgccagacgccggattcgcccgaacccgcgccggcaacgccaccaccactattacccccggcaacatcagcaacgtcggcaacgtcggcgacacaaacaccgtgcgccagctcgtcggacgatgcgccatccgcaccgccacggcataccgtcctcccgcgcgtcatgcagaccatcgaggctccgaccagcatggccagcccgatcagcccgtattcggcgatgacgctggtatacgcgcacatcgtccacaccgtgtccgcgttcacgccggccgcgaatcccgtggccgcgccgccgttcatgccaagaccgtccagcagccgtccggctttggccgcgccggcccacaccgcattgatgatgttgcccgcgccataaccggtgagcagcgtccacggatgggtgagcaatccgcatatcggatcgaggctttggtagatccgcgcgaagaacgagccgtctccctcggccccgttttccgcgatggcggagagtctggaatccgccagcacacccagcaggcccagtgcgcatgcgccgagaatctgcagcatgccccggacgcggcgtgcgccgtcatgccaatcggtgcgcgccacaagggcgatcagcaacgccacgacggaatcgatgacgattctggtgccggcttgcatgagcaccgcgccgacggcatacgtgacgatgaggtcacgcagccgtttgacgtagatgcggtcgcgcccgcgcatgagccacatgagcggaagcagtatgccgaacaggtgcatgccgatatagctgggctcggcgaacaggaactgcggacggccgccgccccacaccgagttgtcgctgatgtattgccggtacatgaggtgcgagaaatagtcggtcaacggtttggcgtgcagacggatggacagccattgtacgacgcccactccgaaggaaacccagtatgatgcgatgagaatccgcaatggcgtacgccacggaatgcgtttgatgtcgaacgcaagggcgatcgcacccaaagtggcgagcacgcccagcaatccggtgatgctcatgaacgcggcgttgaggtggatgccgaacttcagccatcccgggatggacaggattatgcaggccaccggtaggaggaacattggcaggtaccggttggctgcgatgcgcagttgccgccaattgcataggcagtacacggcgaacagcgccggactgattggagaccagaacggcgcgtacaggccaagcgtggtgccgtccaccggaagaaaagcaatggccagcaacagccaaatgacgttgcgttcctgcgatgtcagaaatcgcaggaacgaccggtattgcggtcggccatgatggttgcccgcgtcgatggtgtcgttgcgtacgcatgcctggttcatgtgattctccctccccgtcaaccttactcgttcatcatgatgcgcggacggggcatgctttccccgctgaaagtgcaatggcccgaacattgacaaggtcgcaccgaatgccccccatcattggcacattgtgcgatctcgtcgcggctggctgacgaaataatgttggccgaccggttacattggttcggtacagtggcggcattattggccactgaatcaagcgatttgcggcagaacgacgaaaacaacacttgggcgaaaagaggcaggcatgactacgaatcgaccgctcattgcggtgactccgctgatggattacgggcgcgatagtctgtggatgctgcccggatatatggaggcgataatgcgggccggcggtacgcccgtcatgttgccgctgaccgatgacaccgacattcttgcgcaatgcgccgaacggtttgacgcgtttctgtttacgggcgggccggatgtgggaccgatggttggtgcagcggcctccgccaccggccgtagcgaggtgctctctcctgagcgcgaccgaatggaatcgattctgctgccagctgtaatggcttgggacaagccgattctgggcatctgccgtggcattcagttcatcaacgcagcgctgcgcggcacgttgtggcaggatctgccaagccagcatccgagcgatatcgaacaccatatgaatccgccgtacgatgcgttcgggcataacgtttccttggtgcccggcactcccctggcttcattgttcgcagggcagactgagattgcggtgaatagctatcaccatcaggcggttcgtgagcctgctgctggactcgaggtcatggccgtcgcgcccgacggcgtgatcgaggccctgtaccggccggcaagcaacttcctgtgggccgtgcagtggcatcccgagtttctctacaaggtagatccacgctcgcaggcgatttttgatgcgtttgtggggagttgccgataacagcaaaaggggctgctccggtttcccggaacagccccttttcagcggtagcagtcagcagactgatttagtcatcagtgctggcttgccagcgctgattggcgcgtgcggagaccgccgtccgaaggcgaaggcgtacgaaggtacgtcgaacctgaggaaaggcggtatacactccgccaatcagtgctggttgttgagacggtggtacatctcggacagctccagttccttctcgaactggcgagcggtggtgttctcgtcgatgacggcgagctcaacaccggcgatgcgggcgaagtcttcccaagcctcacgaccaacggaggtggtcatgcaggtgtggtgagaaccaccggcggtgatccagcactcaacagcggtcttcaggctcggcttcggctcccagacggcgcgggcgcacggaagctccttgagggagccctgcggctcaacgacgtcgacgacgtccatgagcaggcggaagcgttcgcgaacgtcggacatggagaccacgacggcgtccttggcgggcttgccggagaagaccaggcggaccgggtcggccttgccgccgatgcccagcgggtggatctccagcttcggcttggcgatggtgccgatggacggggaaacctcgagcatgtgggagcccatgtcgagctcgtcaccctcggtgaagttgtaggagtagtcctccatgagggaggcgccaccctcaaggccgtagcccatgacggcaccgatgcgcacgaggacggcggtcttccagtcgccttcagcggagaagccccagccgtactcggacgggaagcgctgcgggccaacgcccggcagctgcggcagagcgccgaggtcctcgaagttgtcgacgccggcggtgcagccgttggcgcgcatcatgttgaccatcgcggcctcttccttggcggcgatgaacagggagtcgtacttggcgtccagcagagccgggtcgacgtcgtacttggccttgtagtcctcgatgatctccttgacctggtcgtccttgacggcgtcgtacgcagcgacgagctcgttgacggcccaagtgttgatggaggcgccgaacacgcgctcagcctcggtcttgtcgccctcggtgacggcgacgttacgcatgttgtcgccccagcgcatgaccttcatgttgttggaggcatcccagccggcgcaggcgcgggcccaggtgccgagcttctcggcgacctcgggatcggtgtagtgaccgacgacaaccttgcgcttgatgccgaggcgggagacgatgtaaccgaactcacggtcgccgtgggcggcctggttcaggttcatgaagtccatgtcgatggtctcccacgggatttccttgtggtgctgggtggccagctgcagcagcggcttggtcagcacttcgaggccgcgaatccacatcttggccggggagaaggtgtggcaccaggtgatgacgccgatgacgttcgggttggcggaagcctcgaccatgaactccttgacaccgtcggaggacttcagggtgggcttgaggacgatcttggccggaatcttgccggtgttgttcaggtagtcgaccatttcagcggagtgaatggcgacctggcgcagggcttcttcgccgtacaggtcctgcgaaccaacgccgaaccagatttccttgccctcgaaggggttttccataaccatagggttacttcctttacttctttgtttatgggggtttgtttaagtttcattcgccgaccgaggctcccctcagtcagctatcgctgacagctcctctcagagaggggagccaagacaccaccgtgctggcggagtcagcgctgatttgatgtgtgtgcccgcaaggcgcggaaggcgaaggcgtacgaaggtacgtcgagccttccgcaacgcggcggacactccatcaaatcagtgctggccgtagacgttctggtagcggtcgttgagcttatcgatgtcggcctggtcgatctcgatgatgtcaccgagctgacgggcggcccacatggtgtgagcgacttcctcggtcatggcagcggccttgacggcgccttcagcatccttgccgatggtgaaggggccatggttctgcatgaggacggccggggacttcgggtacttcttgagggtctcgacgacacccttgccgatcgcctccgagccgatcagacggaacgggccgaccggcaccgggccgccgaactcgtcacccatcatcgtcaggccgcacgggatgttctgaccagtggcagcccaagcggtggcgtaggtggagtgggtgtgcacgacaccgtagacgtcgggcatgttgcggtagatgtaggcgtgggaagcggtgtccgaggacggggcttcggtgccgtcgaccacgttgccgtcaaggtcgcacacgaccatggaggacggggtcaggtactcgtagcgcaggccggagggcttgatgacgaacaggtcggcggtgtgcagacgctgggaaacgttgcccgcggtccacacgaccaggttccacttgatcagctgctggtgcaggttggagacgacctcacgaacctgcttgacctcggcgcgaacctcggggccgtaatcagccaaagttgccattattggttttcctttccactgtgatggatggacgttttttcaaaatctcaaggacctccctcaatagagggaggtcagaaaggcttacttatcttcgaggttgatggtttcgatggcggcgtgctcgatgggcaggcccttggtgaagcgggcgaagaagtcctcgaaaccaaccacatcggaagccaccggcttctcagtggtggactgggcgtccttgaacacgcaaccgtcaaggaagtcagcgaggttgctgtgatcctcgttggtgttccacaggtagttggcgagcacggccatgccccaggcgccaccttcggcggcggtggacatgaccttgatcggggtgttgaaggcagcagcgagaatcttctgagccaccttcggagtggcgaagatgccgccgtggcccacgagagagtcgacctgcacgcgctcctgcttggtcatcacgtccatgccgatcttgaccggggagaacgcggagaacagctgggcgcgcatgaagttgccgagggtcatgttggcttcggggctgcgggcgaacagcgggcgaccttcaggcagaccggccaggaattcgccggaacggaacgggtagttcagcaggccgccgcagttggcgtccacgtcgtcggcgatggccgcgcggaacagggtgccgtacagcatacctgcgtcaaccggctggccgatagccttggcgaactggccgaacaggccgacccaagcgttgaggtcggaggtgaagttgttggcgtggctcataccggccagatcgccggccggggtggtgaccaagtcaacctcagggtggagggccttgagcttgtgctccagaaccaccatggcgaagatggaggtgccggcggagacgttaccagtgcgtacgcgcacggagttggtggctaccatgccagtaccggcgtcgccctcaggcggggcgagcacgatgccgggcttcagggcaccggacggatcgagcagcttggcaccttcctcggtcagctcgccagccggagtgccggccacgagcggctcaggaagcaggttctccagcttccacggctgggctgcgacctcaggcagagcgtcgaacttctcaatgaatgcggtttcgtaagtgtgagtggtcgggtcaatcgggaacatgccggaggcatcgcccacgccgaggaccttcttaccggtgagcttccagtgcacgtaaccggcgagtgtggtgaagtaagccaccttggagacgtgctcttccttgttgagcacggcctggtacaggtgagcgatggaccaacgctcggggatgttgtactggaacagctcggagagcttcttgtgagcttcggaggtgttggtgttctgccaggtgcggaacggcaccagcagttcgccggcctcgtcgaatgcgaggtaaccgtgcatcatggcggagaagccgatgtggccgacgtgcgtgagcttctcgccataggcggtctcgacgtcgttggccatggaggcgtaagcggactgcaaaccgccccagatctcctcggtggtgtagctccacagaccatcctccaagtgggaggcccagctgtagtcgccggaggcgatggtctggaagttgtcgtcgatgaggacggccttgatgcgggtggagccgaattcgatgcccagcgtggtcttgccagcgcgaatcttctcggcgatgtgggcggcctgctcggccgcgttgtcggttgctgccatatctttcctttgccttggagcgccggcgttgttatccccttccttggggagggtgttagcgctcacaatttccaaaaaaacattgtaccgacaacccgcattcgacacaacttatgccgtgtcacgcatcataacggtttgataacagcgccaatttaccgccgaggagccggccccaaggaccgccgggcacgcacctcggcgggaatcagccccatgccgtgctgggtggtcaggaaggtcggctcgccgccctcccccagcaagcgcagcgtctctcgcatggcggccacgccgagcccctcgaaatcgggatgcacggtggtcagcggtgggtacatgttatccacgccagacatgtcgtcgaatccgaccacgctgatgtcttgcggaatccgaagcccatgctcatgcaacgcgcgcatgatgccaacggcctgattgtcgttcgcggcgacgaccgcggtgggcaacgccgcgcctcgacgcccatactcatcaatgagatgattcatgtgcgcatacgcctcagaggcatcccacgtatggcagcgcacgatctgtgaatcgatggatcgggaggcggcgagcttgcgccacgcatccagtcgggtgtgggcgtcgcgccattcgttgggaccggcaaaatacagagccgatttgtgcccgtattcgcccagcaaggccaccactttggccattgcaccccactggtcgataccgaccagcgcagtgcgacgcttgttttcggtggagataaggcccaatccctcacgcacggtcatttggccgtgggtggcggtgacgatgacgcgcggctgagtgactcgcgcacggcaggcggcggcgaacatcacgtcggtcggagtcaggaagatgaaggcgtcgacgttctgctcgttgaaggtgtcgcacaggttgtcgaagtcggcctgcgcgcacaaggcctcgtggaccatcatcacgctcatgaacagaccgtgctcgcgggccatggattcgatggaggagatggaggaaatcgggccgaagaatttgaggcctccggcgatcagccctatggtgcgcgaacggcgggaagccagtgcgcgcgcggagttggaggggcggtagccgagttggtcaatggcggcctggactcgcgcacgggtggcgtcggaaacgtccggcgagtcattgatcacacgggagacggtttggtggctgactccggcgagcttggccacttcgaacatggacggacgtttgcttggcttgcggctggtcaccatgctacctaacctccccgctggcggccggcatccgtgcacggccaggcttgtaccttaatcaatactgactttagcgcgtccacaacagttttgcgttagcgctcacactatcgtgtcgcacgcggctcaggtcaggtgccatgagacacgatggagcggagtcggcccgtgttcggcgatggcggcacggtgtgcggcggaaccatagcccttgttatgagcccattcgtaggcggcgtaacgtgggttgctttgcgcgaggtcgaccatcagccggtctcgggtcactttggcgatgaccgccgcggtggcgacggtggcgcaatgctggtcgcctttgactttggtcgttatatcggctggaatcggcacgtccggcgcgtcgaacgtgttgagcgccttggtgatgtaatcgctcggcccgtcgagaattccggcgactttgggcagggcgcgaacgctttccccacaatttccaatggattcccctacggagtctcccggacgaccttccacaatctcccccgcagccttttttgccgtcaatccccctccaagccgtaagccaagttcgcgttcgacttggctgagcgcgcgcagggcggccacgccgagcgcataggtgatgccccattcgtcgatctcggtgttgctggcctggcctacggcgtaggccgcgcaccagtcgcgcagttcgtcgaaaatcgcctcgcgcctatgttcggtgagcatcttggagtcggccacgccgtccggtacgccgaggtaggtccgcccggacagttcggcggaatcatcgccgtcaagcggcgccaaatcacaggcccagatggcggcgcacccgaccatcaccggaccggcgagcgcgccgcggccgacttcatcgaatccagtaataaggtcatagccctgggccgcaaggctgcgttccaagtcaagtgtcggggtaatcatgcgcggctcccatcgtctcacaatggttaggattcagacggtccaggttcaaatggttcaggattcagacggcccggaactcaatcagttcaaagactcacacggttcaaaaaagactcaggaattcgagccggaagcgtcaggcacgtccttgaagacttcgtggtggtcatcaatcgcaccaagccggtcaagcggccagtatttcgcgattccgactccgaccacatcggagatgggaaccaagccgcgatcgccgtcatcctgatgatagcgggagtcggcggaattggcgcgattgtcgcccatgacgaacacgtggccctcggtcacggtcaccgagaacgggaaagcgctcgggtccacgccggggcgaatgtaggaggtctcattgatggccacgccgttgatggtcaccggctggcccgcgcccttgcattcgaccacgtcaccgggcaggccgatcagtcgcttgatgaggtacccgccaccgggagcgctgctctgctcctcgttcaaccagttgttgggatctttgaataccacgacgtcgccgcgctgcagatcgaagatcttgggggtgagcttgctggtcaccacgcgatcgccgggcaccatggtgtccatcatcgagcgcgaaggaatctcgtaaaagccgacggcgaaaatgcgaatcagcagcacgataagcacgggaacgccgcaccacaggaaaaagtcgcgtagggtgaaggggtcatcatccatcgatgatgctgccgcggcattcgcaccagcggaagaagcggcgtgcgccgggcgcgccggtgccgggggaaccggggacggggcgatgccgtggtcggcgacttggaacgtacgggaatcgcgggcatcggcctcgtcatcatacgaggtctgattgctctccggattgtcggaaaccgggaattcgccgttatcctgatcgtcctgcataccatctcctcgcgattcatgctgccggatatgaggggtgccggcgcccgtccatcatacgtggaaaatacggaaacagcccgaaaccgaaacggttccgggctgaatttcacggtttattcgcgcacctgcatcatcaggcccacgattgcacccgcgaatcgactcacttagcggagttgtcgcggcgctcggcaatacgagcggccttaccgcgcagagcgcgcaggtagtacagcttggcgcggcgcacacggcccttacgcacgagcttgatggagtcgatggacggggagtgcaccgggaagcgacgctccacaccagtgccgaagctgatcttgcggaccacgaaggtctcacgcacgccagcgcccttacgagcgatcaccacgccggtgaaggtctggatacgggagttgttgccttcctggatcttcacgttcacgtcgacggtgtcgccgggacggaaggccgggatttcctcggccggcttcatgtgcttggcgtcaaaagcctcaacagcgttaaccattgttttccttcagtgctgccgcatatcagccacagatctggggccatccacgcgattgcgcatcgcgcgcgttgacctgttctcgttatccctcgggtttgcccttgggaagcctgccgatccgccgaaagtcaggccttgcggccgttcggactggacccatggagacgtgagcttatgcggcggcccacttctcgacacagcaatcgattattctacggattattgcggacagaatcggcgtgtcgtcgtctctctccgttattaacgcatcagtttggccgaggcagcacggatggcggattcgaatactttccgccccctcctgctggtcgcatggataccgacgatggtattgatttggcgtttcaacgcacggcttgaaggaggtgagagtccgatggacggtgattattccagtagttccgccgccggcaacagtcatagttgagggggagcatacggagcgttccataactccctctcagtcagcttcgctgacagctcccctcagtattgagaggagctagaaaagcgaatcagaattcgcgacgtgggcagtcgccagactgcccaccagacagcacagccgcggtcgcgcgaatcacgaattctgaccgagcaaagcgaatcagaattcgcgatttgcgcggtagaacttgatcaggctctgggtggaggcgtcctgggcggcgagggcgtcatcgtcctgggagatggccggggtgatctgcttggcaagctgcttgccgagctcgacgccccactggtcgtaggagtcgaggccccagacggtgccttccacgaaggtgatgtgctcgtacagggcgatcagctcgccgagtgcgaacggggtcagagccacaccgaagatggaggtggtcggacggttgccggagaacacgcgggccggaacgatctcttccggagtaccctcggcgcgaacctcgtcagcggtcttaccgaacgccagggccttggtctgagcgaagtagttgcccaggaacagctcgtgcacgtcctggtcgccgtccttggtcgggttcggggtgttgacgaacgcgatgaagtcggccggaatgagctgggtgccctggtgaatcagctggtagaaggcgtgctggccgttggtgccaggctcgccccagaagatctcgccggtctcggaggtgacgggggtaccgtcccaacgcacggacttgccgttggactccatggtcagctgctgcaggtaagccgggaagcggtgcaggtactggtcgtacggcagcacggcgtgggaagcaaccttgaagaagttgcggtaccagacgttcagcatgccgagcagcaccacgacgttcttctcgaacggggtgttggcgaagtactcgtcgatctcgtggaagccgtgcaggaactcctcgaaacgggccgggccgaagatcacggccagggaggtgccgacggcggaatcgacggagtaacggccgccaacccagttccagaagccgaacgcgttgttcgggtcgatgccgaactcctcgaccttctccaggttggtggagacggcgacgaagtgcttcttgatggcctcggccttctgagcctcgtcgccctcggcgatggcgccgttggcggtgagctcttcgagcagccaggtgcgggcttcgcgagcgttggtcagggtctccagggtggtgaaggtcttggagacgatgatgaacagggtggtctccgggtcgaggcccttggtcttctcggccaggtcgttcgggtcgatgttggagatgtagcgggcggagatgccagcgtcagcgtacggcttcagagcttcgtacaccatgacggggcccaggtcggagccgccgatgccgatgttgaccacggtctcgatcttgcggccggtcacaccggtccacttgccggaacgcacgtcgtcagcgaaagcgtagatcttgtcgagtgtctcgcgcacgtccttgacggtgtcctgaccgtcaacgatgtacttgccctcgtcttcgaccgggcggcgcagcgcggtgtgcagcacggcgcggtcttcggtgttgttgatgtgcacgccggtgtacatagccttggtgcgctcatcgagcttgacggccttggcaaggttggcgaacagctggagggtttccggcttgatcaggttcttggacagatcgaagtgcaggtcgccggcgtcgaaggacagcttctcgacgcgctcggcgtcctcggcgaaccacttcttgaggctcacgccttcgacctgaagctcgtcatagtgcttctgcagggcagcccactcaggggtctgggtggcgtcaacgggcggattgatggccataggattccattcctttcatcagtgactggagcgcccttgcacacggctcggatgcgctccgtatcaccaaacagaatactcacaaattcggacatgaacagaacaaaatgagtcagcgatgtcggattgccatcgtttgcattatcgaacagttcacggcgcggcgcaaccgtcatcttcgactgagcggtcgcgacacaaccgccaatccgccgattggacttttcgtggggatgtcttatacttaacttcttgtgcgcggctggcgaaatgccttccgcgaaccaagccactttagctcagtcggtagagcggctcactcgtaatgagcaggtcgtcagttcgattctgacaagtggctcggatgccctaggctggctggtctgtaatggctgtccggcctagggttttgcatatcttccacacctgtggaaacgcggatatgcacgcgcgagtggcggaattggtagacgcgcaggatttaggttcctgtgtctttgacgtgtgggttcaagtcccatctcgcgcaccggcttgagcctcttggaagcattggattgccaacgcttccgggaggcttttcgtatatgcgcgcggcagctgcaagcccttgcggacacctctacatatggcaatgccaaggcggcaaatataatgggccacagcattgcgggtctgagcctgtgcgccatgagcctgtgtgagtcaaggagagaagtgtatgtccgccattcttacgccggttggtctgttgctgatcatcctcgccggctatctgttcaagcggttcggcctgttcgggcagaaggattatcgcgtgctgcaaaccgcggaattcaacatcgtgctgcccggtgccatcgtatactcgttcgccaccaatccgcatgacatctcgctgctgcttatttcggtattcgcattcctgtttgcttttatcccggtcgtgttcatctttctggccacccgcaagcgcaatgtgaccgaccgcgccttcctgatgctcaacggtgccggcttcaatctcggctgtttttctttcccggtcgtccagtcattctggggtgcgggcgcggtggtgccggctgcgatgttcgatatcggcaactgcgtgatggtggccgccggcaccaatgtgctcacccagcaactgctgcatattcagcccggcaaaacacttgccgaacaacacgccggttcggctcccaccctaccgtacgaaaagcccaaggatcgcgacgccaaacggcttgcccgccgcgcattgctgcgcaccatcggcaagagcttcttcggctcggtgccgttcgacacgtatctgctcatgatcgtgttgaccgtcgccaacgtgaagattcccgattggatcgcctctataacccagccattgagcggcgccaacgcgctggtgtcgatgctgatggtgggcatgctcatggacctgccccaatccaagcatgacgtgaaggaagtcatggccgtcatcgcttggcgtataccgttcagcgtcgccttcgcgttgatcgcgtggttcctgctgccgttctcggcttcgattcgcgccgtgatggtgatctgcgcgttggctccgatcgccattttctccacgctgttcaccgacaaagtactcggcaacgccaaactggccggcttctcgctggcaatcaccgcgatgatttcactggtgatgatggctgtggctcacgcgctgatgggcgtgtgagcaaatgcgcaagtaggcacacggcgggtgcacggtcagacgagacgcagcccacataggctcgtcccccgaccgccagttgctaccggcgcagcagcttgtgcgccagattgctcacaccgaagcggaacttatccaccggcaacgtgaattttcctaccatctgctcgacgtagccgttaaagccctgcttgaattccagcacgccgcggccctcgtcgttcggatcgtcgaacacgccggaaatgccgtagaagttgtagcggctcacgccctgttccacacacagatgcagcattgcttcgtactgaatcagcgccgaggcgtagaacggcttgtactcctccaacgaaccggaatactgatagaccacctcattggggtgactgacgaacattgaagccgctgccggcagcacatcgcccttcctggcatatccctccacctcagccagacgcttgtcggcggccgcgagattgcgtgattcctcccccagctgacgttcgatacgcgtggtcggacgttcatcgtatttcgcctgcaatcgagctaccttggcctgcaacgcctcgcgcttggcggtcatatccgccacatattcggcgatgtggatttccgcgagcatgaaatgcgcatctgcgccatacgcctgcttgaactggcggaaatagtctgcgccacgcgtcgcgaacccacggcgttcaccggtccgccgttcgatatcggcgaacacgtcgaactcgtcggggccgatttcgcgaacgtgcacacccatcgactgcgcccgcttgacactccactgagcacgtttgccgaatgacgccagcagttccttgccgttggtgatgccggtgagatccttgacgtacatccactgacagaccacgtcataaccggtatggaatccgccatgcgtccagccggcatcggcgaatccggccagcagtgcatcgttcggctcgccgtcgggctgcccgttcgaggaatacagacggtaggcgacgttaggccagcatgccacggaaacagcatggtggcgacgggccgattcacgaatcgcctcggttatggcccgcagcagagccggatcatcgctaatgccgatggggccgaaatatacggagccatctgcaccgaaacgaccattgaggtacagaatcacgcagccggttaccagattgccggatgcgtcgcacacgccaacgcattcggcttcatgcccacgaatcttggcaagacggacctgcccggaccattgctggaagctgccctggcttgtggcttcggaaagccggtcgagctcttcgggcgtaatcacgccaaacgtatacgtcgtatctgttcgattcgcagtcgcgctcatctcgtcgtcacctgtgccttatttctgtgtccgtgctcgccactgtttgtcagcgatgcagcagcttgtgcgctgcttcggatacaccgaagcgcagtccgtccaccggcagcgtgaacttgcccggaagctcttccacgaatccgccgaagcgagtcttgaactgccagacgccgtaggaaggatcgttggcgtcgaaaatgccggaaatgccgtagaagttgaagcgctccacgccacgggcgatgcagtcaagcatcgcctcgaagtggattagggaagacgggtagtaatccatgaaacgatcgtcctcgccgctggacaggcagacgacctcgttcggatgccagaagtagacgccggcttccaccggaatgaccgggccgtccgaagcgatgatgccattgacttcgccgatggtcttttccagcgccgcaatcttcttgtctgcggtggcgatgcgcttttccagcgttgccgggtcggaagcacccttcttggccgtgccttccggctgctgttgcgtgcgctggagcaggcgttcgaggttgcgcttgtctttggaggccgcattcagcttggattgcagggtgtccagatattcgtcgaaatgggtttcgaccaccttgaactcgatcaggtcgccgaaggtatcgaacagacgctcatagtaggccagatcgcggctcttgaagccttgacgtgcggcgctcatatcgcacagcttgacgaaagtgctcagttcgccgcgttccagccggcgcacgcgcagaccggaatcctgggcaatgcggatgttcttacggcggtacttggagaacgaggccagcagttccttctcattatgaatgccgtcaagccccttgacgaagttccagcggttcaccacggattcgtagcccacggtgaaaccgccatgtttccaaccgaagcgggccatgttgtccatcatcgtggtgtccgggtcgctggtcggcttgccgtccagatcatgcagacggtagactgcggccggccagcaggatacgctgatggcgtgatgggccttggccgaacgacgcagggcttcggtcatcgcctcaaccacctgtggattgtcataatcgcacagcggtccgcaccagaccgagccttccaaaccgaaacgggaccgcgtgtacaccacgtagcaggcggcaatcagcttgtcaccgcgcttgacacccacatagtccaccggaccgttgaacgcacccatggcggccatctgcgaggtctgctggaaactaccttgcacttgagctgcggagaacgcatccagctcggcaggagtgatcttggtaggggtgagcgaggcgacgcctgcatcggattgcgtcataatcgaaccttcttacttgtcgttactctgatcgttactctgggctctggaatggcctgtgtgctgcgtccgtttaccgcgacagcagcttgtgcgcaaattgcttcatggcataggcgaccggtttgaccggcagcacaaactcgcccggaagttcctcgacatatccgttgaagccctgcttgaactccagtacaccacgcccctcgtcatcgggatcatcaaagacgccgtcgatgccgtagaagttgtagcgagacagcccgtgttccacgcagaaatgcagcatcgcgtcatgctgaatcagcgcggaggcgtagaagggcttgtactgctcgacgctaccggagaacaggtagatgacctcgcgcggatgctccacgaatagtgatgccgcagccggcagcacatccccgtctttggcgaactcggccgcctcgttcaggcgcttttcggctgccgccagattgcgggtctcctcccccagctgacgttcggttttggtggtggggtgttcggcgtttttggcggtcaatgccgccaccttggccgaaagcgcttcacgcttggacgtcatgtctgctacgtattcgtcgatgtggatctcggcaaccataaaatgcgctttgctgccgaacgcttccttgaaacggtggaaatatgcttcgccacggtattcgaagctacggcgttcagcggtttgctgctcgattcgtgcgaatacccccagctcgtcgtccgacagctcacgcacgtgcacacccatcgattgggcacgcttcacgctccactgggtgcgcttgtcataggacttcagcagacttttctcatcggtaatgccggtcagatccttgaggtagcgccaacgcggaaccgccgtgtagcccacggtgaaaccgccatgagtgaagccgatcgcctcgagctgttctatcagcttattgtcgggagcgccattctggtcatccggcaaagaagctccattggtgtcgcgaagccgatacggggattcaggggtgatttccagctgtgaagcaccctttgccttggcatggcgtttcagcgcatccatgaagaaggtcaatgcttcggtgtcgtgatagtcgcacatcgggccatcatggatgaccgcaaatgtagagaatcgagagcggtgagtttcgaacagtgccgccgcgacgatcttctcgccctccttgagggccaaatattcgacgtcgatcccctgcgcggcgcgaaggcgtcccatcgccgaggtttgttggaaattgccttgtggatgcctggcggagaaatcatcgaactcctcgtctgtcaacttcaccagcacaaaatcacgcatgcttccctttgcctccgagtcaatcaggctcaccatgctagcatagcgcgcacacgacgaatggcggccgagcagatgaggtgtgcacatcgttcgcactattgccgccacgatggtccaaagaacaatggcccaaagatgatgaatgtccggcttgcagtgaatcaaacgcagtgctatattctctacttggctcttgaagccacgccaccttagctcagtggtagagcatccccctcgttcgtgggaaggtcggtagttcgattctatcgggtggctcttgttcatcaagaaggccgacgcactaagcgccggccttctttcgtatcgcccttgctaggtcataggcgcttgctagacactcgcccgattcgggggctgagtgctgagccgcgactcaactgtggcttagtcgcggctcagtgcagctagacagcctagacgacttagtgcagcagggcctcgatggcggggaccaaggctttcagcgccttgcctcggtgggaaatcgcattcttctcggccggagtcatctcggcgctggtcagcggctcgccttcatggtcaggctcagtgctgacgcgaccggcaggctgatcgtccgggacaaacagcggatcgtaaccgaaaccgtgtacgccacgagcctcgcggatgatgcgacccggcatgtcgccgagctccactgtctccgacttgatggcgtatcgagcatgcaccggggcagggctcccatcggcagccgtggtgtgaacggtgatgccgtcggcagccactccaccggtcacgtcggcaccggtctcggtgtccgggaccaccagcgcggcggcgcaacggaagcgcgcggtacgcttgtcatccggaatatcttcgatttgggcgagcagcagcgcattattggccttgtcgtggccgtgagcacccgcccagcgagcagacagaatgcccggagcgttacccatcacatcgacgatgagacctgaatcatccgcgacagcgggcagaccggtacggatggccacagcgcgggccttgagtagcgcgttctcctggaaggtgacgccagtttccaccggatccggcaggtgaaggctgccagcggacaccagttcgatgttttcggcatccgcgccaagatcctcttcgagaatgcggcggatttccacaagcttgccttcgttatgggttgcgacgacgatttgcatgaggttctcctttaagaaggctccccttgtcaggggagctggcttagtctagggacagagcggcacgctgggcggcttgcagttccttgttgcccttttcgcccaagtcaagcagggtgccgagttcggcacggttgaacggacggtgttctgcggtgccctgaatctcgatgaaggtgccggaaccggtcatggccacgttcatgtcggtcatggcctgactgtcttcaatgtatggcaggtcaagcataggagtgccgttgatcacgcccacagacacggcggacacatagtccttaagcacgcggctggcggacttgatatggcggtgcttctccgcccaattaactgcgtcgaccaaagccacatacgcaccggttacggaagccgtgcgagtgccgccatcggcctgaagcacatcgcagtcaagctgaatctgattctcgccgagcgccttcatatcgatgacgccacgcaggcagcggccaatcagtcggctgatttcgtgggtacggccaccgattttgccacgtacggattcacggtcggtgcgttcggcggtggcacgcggcagcatcgagtattcggcggtgacccagccgaggccggagtccttgcgccaacgcggcacaccgggagtaaaagtggcggtgcacatcacgcgcgtgttaccgcattcgatgagcacggagccttcgggggcgtcggtgaagtggcgggtgatgcgcacagggcgcagttcgtcgaccttgcggccgtcggcacgaattatttggtgattgccaagcatgtctttgatttcaaccatgcgccccagcatacgccatccgctctatgcctggatagcaactcgtcaaccatcatcgaactccagcgcaatgtcattccctgcttacatatccatcccatgacacttggctgcacgccactattttcttatgcaccactcgcttacagagtcaatgcctgcgtacctgatgaggattgggaaagatcgtccgctggaataaggatgccatattccatgaaagcttggttgaattgcttgcgctgcatagcgttgagttcgtaatcgattaacggcaaatatgtatagtccatgtcatgcaacggctcttcatatcgatgaagcacgtgcataattgccgcgctcggcagtggggaccaccatccatccaagccataccggtacggaggaaccaatgtcaagcgtctgttccttgggttgatatcccaacgcagaaaacggtataaaccagcgagaaacgcaatccagcacgcatcgttcacccgtgcaaccgctcggacgaacgatatacgttgatgttgaacattccgagcatgaatcagattgacgcagagcatcttcaacgtagaccaggtcgctccgctttctattgcatcgaaatcaggaggcctacgcagttgcgccaacaacatgtgcaattcgtcttccggaatcgtttgcgagggggccacggcttctaggtgaagaccaaaaccagcccgctcaagcccctcgaccaaaacatcaaacaacatacctctttgcccacgcaatacgcgaccaattgcagaccgatccaaaccagtgcgctgtgcaagctcataggcattccaaccagtctgcgacatcacttcattcagcacagccgcacacgaattaacagggcaaccagataccacaccgtgatgcacgacatcgcactgttctaacgctcgatgctctacagcgcgccgctctgatacgtcatcgttgcccgccgcgttctcatcattgagagtttcactcatcgaagtcaccttgcctcggccgatttcccggtcatttcatcaaaccgcaatcatcatatcccacaatcccatgacgatacgattcgtcatatcccacaattcagagacggtatgattcgtatcgcatcagttcacacgattcttcaacgattgctccgcaaacgattgctctgcacgcatcacggcattctaccggcacactattcctcccaatcagcccaacgcaacatcacacgcaacatcacacgcaacatcacacgcaacatccctcacgcaacacccctcacgcaacacccctcacgcaacacccctcacgcaacacccctcgcgcaacactgcgccatctctgtaacatcaccgacaacacggcaatcccacaacgtctcggtgcaatatcctctgaaatggtttggttttcactccacctcgtcggcatcctgaccaggataggaatatgtgtcgttccgcaccatgtacaaaacgttgtcaactgacaacgttcttcaaatcaattggataagacaaatggccatttcccgccaattcatctgaatcaagacgttgtcaactgacaacaaaatgtacattgcaacagcatgcacatatacatatttccccggtgagcagtacccattaccatgtttggtaggtcccgatggtcggggccgggtcgccggttccggtcttcgaacacttccaaccctagacaaggtgttgcacttctatttagaacccgggtatttaccgccgcccagaccacacggtatggtagagcgcatggctgattacgggaacaactttgtgcaactgcataaccacacgcactattcgctgctcgatggtgcgtcgaagattccggatttggccaaacgcgccgccgaacttggcatgcctgcggtcggcatcaccgaccatggcaacatgcatggcgcctacgagatgtacaccaactgcgtggccaatggcgtcaagcccatcatcggcatcgaagcttatgtgaccccggaaaccgcacgtcaagacaagtcccgcgtgcattggggtaccgaagcccagcgccgcgacgacgtctccggtggtggtcttatcacccacttgaccatgtgggccgaaaacgacgaaggcctggtcaacctcatcaaagcctcgtccgtggccaacctcgaaggtcgcgtcatgcgttatccgcgtatggataaggaggtgctcgccacctattccaaaggcgtgatcgcatcctccggctgcccctcgggcatcatccagacccgtctgcgcctcggtcaattcgatgaggccctgcgcgccgccggcgaattccaggacatcttcggcaaagacaacttcttcatcgaacttatggatcacggtctgcccatcgaaactcaggtgaccggtgacctgctgaccatcgccaagaaactcaacgcaccactgctggccaccaacgattcccactacgtacacgccgaagatgcacaggcgcaggacgccatgctctgcatcaactccggttcccgtcttgacgatccggaccgattcaagttcgacggcaccggctactacatcaaaaccgccgaagagatgcgcgaactgttcaaggaccacccggacgcctgcgacaatacgctcgttatcgccgaacgctgcaacgtgatgttcgacgaccacgaagacggcgcgttcatgccgaaattcccttgccccgaaggctgggatgagacctccctgttcctcaaaaaagtcgaggaaggtctggagaagcgttacgacggcaacccgccgctcgacgtattgaagcaggccgactacgaatgcggcgtgatctgccagatgcagttctgcggatacttcctcgtggtcgccgactacattcagtgggccaaggatcacggcattatggtggggccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagcctgcatgacatcttcgacccgaccgccaaacgctacgccgaggccagggaattccgagaactctacgattccgacccggacaccaagcgcatcaccgaagaagccaagggtatcgaaggcctgattcgacagaccggtgtacatgcctgcgccaccatcatgggtagcgcacccatcaccgacacctcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgctctgtaccgaccgggcccgatgagtatggattcgcacaccaactacgccaagcgcaagaatggcctgcagaagatcacgccaatccaccctgagcttgaggaacctctgaagcaggtgcttgacgagacctatggtctgatcatctaccaggagcaggtgcagtccgccgcccgaatcctcgccggctattcgctgggcaaggcagacgtgctgcgtcgagccatgggtaagaagaagcccgaagtgctggccaaggagaaggtgccgttcttcgccggtatgaaggagcatggatactccgaagaggcctcccaggccgtgtgggatattctggtgccgttctccggctacgctttcaacaaagcgcactccgccgcatacggtctgatctcctactggaccgcatatctgaagacgcactacccggtcgaattcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgttcaccgtgcacgaggccgccatcgactcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaaacttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccatccaatgcatgttcttcggcaaggtctatgaagcggccgccgccgaacttgccgtggacgccatcgtacagattcgtggccaagtggagttgcgcgacgaaaccgtttctctgagagccacggaaatgcagattccgaccttggaagccgaggatgaacgtccgttggtcatcacgctgccgccggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgagatacttcgttgtttgctgagatcaagattctgtttggccccagctgcttgcctgccgcctgattggcgggtttcgcccctggcctctccctcacctggctttgctgggggctccttcatcagagggagctaaggcgtgtgccaccatacgatgtgcgcgactactgtggaacgtatgggcatggagatggcggatactggtaacaacgatgacgagcaacaatggattgccacgatgctggaacggctgtctcattcgcagttccgcgccaaattcgctttgaccgacaaagaccgagcctatgcccgcaccaaaggcaaggcgaccatcgatcgtcatgcgcgagaaatgttgcgagaccgcataggcgcagccgaaccgaagaacgacggcaggcagacgccatggcgcggccatccggtattcaccgctcagcatgctaccgccacatgctgccgcggatgcatcgaaaaatggcatcatctgcccaaaggccgtgaactcgccgaagcggaggtaaaccgacttgccgatttggtcatggcatggattgagcgggaccttatcaatcatccggttcggtgaagcacccagcatcctcagtatgcctgtatgccttcaatagttatgagccaacagccaacataggcctcgaaaaccgtagacgcaaggtattggcgaatgcggcagaacgccgaacgttgcctatggcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggcctcggctatgtgatgcgtggcggccgcgagatggacaatcatttcgaggtcatgtgggatctgttccgctcgattccctccatcgaaaccgagggcgtcagcgtactcgacgagtactactggctcaacaaggaggacccgaactactcgctgtgccgcgccaccaaggacctcggcaaggacgcggggctcaagggcaagttcggcctgtccgacaaggcttcgatggaaatcatgaagctgttcttcaccccggacgaagacctgtatgacaagccgatcaccgatttcttcgatgatgaggtgctgaactccaacttctggctgtactggcgcaccatgttcgccttcgagaactggcactccgcgctggaaatgaagctgtacatcaaacgctacattcatcacatcggcggactgccggacttttccgcgctgcgtttcacccgctacaaccagtacgagtcgatgattctgccgatggtcaagtatctggaatcgcatggcgtcgaattccgctacaacaccaaggtcgagaacgtggaattcgcgattggcgggggagccggccccaggcgcgagcacaccggcgtaggccaagacaccatccaaaagattcaggccacctccggtttcttcaagcgcaaccctgccagcacgcccaccaagaagcttgccgtgcgcatcgacgtggaccacgagggtgataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgccgaccaggacccgagctttggccatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgctcgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcaaggtgaggggagccagcacgcgaagcgtgattgaggagagttgctcacaacggagtgttaagagaaagacaaaaacatgactgattctgatccccagttaatccgccacgccaccatcgacgatctggacgcgctggccgccatggaatccgaatgcttcccggccgccgaggccgccgaccgctcgtccctgcgcgcccgaatcgagacctatccggaatgtttctggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtgcactcatgaggaaagtcattgaagacactcgtgcagctggacgtaaaggcttggtgctcacctgcaaagatcggctggtcggattctatgcgcaatttgggtatgaggacgagggcatttcggagtccactcacggtgacgtggtctggcatcagatgcgcctgaccttctaatccccctttggctcccctctttgatgctgaggcgtctaaaaaaacagtccggtggactgtttttttagacgaaggcgagacgatagtcgagccataaggacgagagctttttgcgggtgagccgtccgcgtgatcggactgaggggagttgaacgtggaataaattgttgcgacacgccggtgaacatctgatttcgttacgtgagccccataaaaagccggcgtatcctgatggtaacggcgtgattcaagctgatttcgacacgccgatggaacgacgtcgttgcaacgattccttgggtttttgcgcttcgaacacttccaaccctagacaaggtgttgcacttctatttagaacccgggtcgaacgcgggatgagcagcattcgtgctagggtgtgcagaagaatgaaagaacaagggcattgttcctctgaaggttgaggggaatcacggaggaagaatttagacatcatgtcgaaagatagaggtacagcatttgtatcatccacgcaaaataatggtactggcaccaggtcaatgcctcatgtgaggatcagcgccagccgagcgtcggcatcgttctctgcaccggtggatacggcagccatcacgccgacattctttgacggtacttatttctcttctgctccggacggtagctctactcacaacgacaatatgggcactcactatctcaccggctattccattccgaaatggcgctacatttacaacaccacactggtggcactcgacctgttgacgatcattgcggcctcaggaatcgtgttcttgttccgtccttccgcctacgcatacgtgcgaggcataggtcctggagaatacggcatattcagcttcctggcgctggcttgcgcctcttggctcatcagtctatatgctgcacgcacttacgaacggcataccatgagtgaaggttacgccctgtatgccaagctactcaacgcagcgttcattgactttatcatgctatgcacgttgggctacctcttccatctcagtcttccccggtcattaaacatcttcgttcctctagtttcactagtactggtcatcatcgagcgttgggcgatgcgccgtgccttgcaccgcaaccgtatgaagggcgaattcaactatcccacggtagtaatcggttctccagaaggaatccatgacgcgctcgaacaattgcgccaatgtccaagtgttggctatgcaccggttgctgtgtgcccggttgtttcggccaaaaaagaggatgatgccgatcaggctcagcatctggtgtcggtaccattcacccccgctaatgatagcgaagctcggttgaaggtattgccacttaattcccatctgcctcagacagccaagcgtatgaaagcacacactgtgctagtggccgacgtactgacccgcaattccgaaaccatgcgtacgttgtcgctcgcggtggagtccatgggcattgagttggcaatgactgcgtccgtggccgatctaagcggcgcagatctgcacttccgcaataatccgagtatgccggtggtcactgctagactcacgcagtattcagccattactcgcattctcaagcgtatttgcgatatcgtgctttccgccatcgccattattctgagctcgcccatcatgctgtgggtggcgtataaagtcaaacgagaagacggcggcccggtgttctattcacaaacacgcattggcatttacggcaagccgtttaccatgtataagttccgttccatgcgtaccgatgccgacaagatcaaggccaaattggctaaggaacgtggcattgaggatcgcttcgttttcaaactcaaggatgatccgcgcgtgaccaagatcggtcattttattcgcaagacgtctctggatgagttcccgcagttctttaacgtgttcaagggcgatatgagtctggtcgggcctcgcccgccgctgcctgaggaagtcgcacgatatggcatgctgtattccacacgactgttggtgaagcctggtattactgggccttggcagatttccggacgcagcgatttgactcagaaacagtcggaatatgcggatgtgtcatatattcaggactggtccattaccggagatattgcgattctgttgaagacagtagtcgctgtgtttaagggaactgggtcatactgagttttcttgagtcttcgccagtttgtgtagtgaggggcggggtcggtgtcgttgacgggttcttcctgtgtgcgggtatgaaaggggcgttctcctgttaggtttgtttccgccaaaaacacaaacagaaaaacagagggaacgcctttgcccaccatatcagccggcgtgccgcgcatcgagaaggacccacatggcggagacgtcgtcatagtcccggtccgaccgtacgcgaaggacatggaccggtgcaccaggtgcgagaagcatgtcaggccgtacgaccggctaggcgtgcgccggtggcgtcacctcgacatcgggtgcgccaggctcatgctggagtacgcgccgccgcacgtgacatgcgctgatcacggcgtgaccgtcgcgatgatgccgtgggccagacgcaagagcgcgtacacgcgcgatttcgaacagcagacggcgcttctgaacgtgcacgagcccagaagcgcggtgagccggctgatgcgcatggactggaagagcgtgggcccggtatgcagacgggtcgccgacgacctgcgagcggagcaggggccgggcctgttcgacgggccgcgttccatcggcgtggacgagaccagctacaggaagggccacaagtacatgaccgtggtcgtcgaccacgaccggggcgcgtcatctggatgcatcagggtcacggacagaaggtgttcgacgagcttgtcgaattgtttgtgtatgggacttatttgaggcttctgctgttttcgtgggttagatcgtgggttgtggtagtcggatgtcgagtccaccgcatcggagcatgatcagggcgatgaggttgtcgacgtggtggaagccgtaggccatgcggatggtgaccttgatcctgttgttgaaggcctcgagcctggcgttggagtagcccagctggatcgtgcgcatcgttcgtcatgaggataagaccctcggaatcgtagtcgagacggcccatgtggaagatgcgctcgtacttgtcgcccacgatgtcgcgcagcgtgtagcggcccttcgggtcgtccatggcggagagcaccttgcggggcttgttcagcgccagagtgacgtggttcggattgacgcgtacgcgcgaaccgtctacgcgcacctgctgcttatgagggtcaacgcgagttccgagctcggtgaccagttcaccgtcgacctcgacacggccttcggtgatcatgtcctcgcacttgcggcgggaaccgaatcccgcttgggcaagcagcttctggagtcgaatggaattggaatcgtcttgcgctttcgcagcgcgggaatatgcgtttggcatcgttctcccaacgtggccggacagattctgtcatcgcagagactgtcgatttgtatacatacttcagagttggcggactggaatcccagccaatcccaacctatatatcataccgcaacgtaggactgctgctagactggcaaccgtttgtgcgggttcgcccgtcttccgacagatgaaaaggaatgaacaatcatggaagaaaccaatcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctctgtgctggtttccaagacgaaaatcctggatggcatcctctatgtgatcgctcaggtcatcggtgccatcgccgccggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacgacgagtcctcggaccgtcatgtcattgccatgggtcttgcctatggtctggccaccgccatcagctacccggttaccggtgccggtctcaatcccgcccgttccaccggcatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactgagcgcactttccatgggcttctgtcctgaagaatcaggcgaacaagcccggtgatgatggccgtcacggcaagtatgaccgtggcggccatcgtatatccgaaagcaaccagcagtgtgatgacggcgacgacgccgagtacgcaccattcaaaccatggcttgccctcatgtgcttcggatacatagggatggttatgcatgttgcgattccttctgtcgaacggttacgtgaccacaatagcaggcgaatagcaaaggtgggattccgcttggacccgttgacgggtcaggcggaatcccacctttgtgcgttttggctgagctgctcccctcagagagtcccgatcagtggaagaagtggcgggtgccggtgaggtacatggtcacgccggccttcttgaccgcttcgatgacctcctcatcgcggatggagccgccaggctgcacgatggccttgacgcccgcgtcgataagcacctgggcaccatcggcgaacgggaagaacgcatcggatgccgcgaccgcaccggtggcgcgatcggcaccatcggccagcgtgttggcgcgctcgacggccaaatggcaggagtccacgcggttgacttggcccatgccgatgccaaccgtggcctggtcgtgggccagcaggatggcgttggacttcacgcagcggattgcacgccatgcgaacacgaggtccttcagcgtgtcagcgtcggcggcctcgccggccacgagcttccaggcgtccggatcgtcgccgacggcgttgatcagatcagtgtcctgcacaagcaggccgccatcgatctggcggatggcctcgtggcccttcggcggctcggccacctcgaggatgcgcaggttcttcttcttggtctgcagcagttcgagcgcggccggctcatagtcgggggcgacgatgacttcggtgaaaatcgggcgcacgctttcggccatctcaagggtgaccttggagttgcaggcgatcacaccgccgtaggcgctcatcgggtcgcaggcgtgagccttcttgtgggcctcggccgcggtcgcgccgatggccagaccgcacggattgttgtgcttgactacggccacggcaatggcgggagccatatcccatacggtgcgccaggcggcgtccgcgtccacgtagttgttgtagctcatcggcttgccgccgagctgctcggcgtgggcgaaaccggtctggttgagcgggtcgatgtagagggcggcctgctggtgggagttctcgccgtagcgcagggtgtgcgcacgatcccaggtgcgggtgaactgggccgggaacttggcggaatcgacttcagtgccctgatcgtccttgtccacctcgacggcgtccagagaggccggcttgggccagtgcttggcggtccactcgttgatggtggcgtcataggcggcggtgtgcgcgaaggccttggcggcaagccacttgcgctcgtccaaggagaagccggtgccgtcggccacgcgggaggcgaccagtgcataatcggccgggtcggtgacgatggccacggtggcgtggttcttggccgcgccgcgcaccatggagggaccgccgatgtcgatcttctcgatggtatcggcctcgttggcgccggagcgcacggtgtcggcgaacgggtacaggttgacgaccaccaggtcgaacggcttgatgccgaactcctcgagctgcttggcgtgctcggggttggtcatatcagccagaatgccggcgtgaatgtacgggtgcagcgtcttgacgcggccgtcgaggcattcggggaatccggtgacatcggacacctcggttaccttgacgcccagttcggcaagcttcttggcggtcgaaccagtggaaacaacttcggtgccggccttcacgaacgcttccgcgagtacttcgatgccttccttatgaaagaccgagaccagtgctcgacgtatcggtcggttcgtgtttgtcatcctgttcctccttggattcttgtggttgtgacgctaggaaccgcgcctgatgaacggtggcggtcttcgaggtcgtggcggtggtgcgggaatccttgattctctcaaccaaccagactatcggaaaaacgagcgctatgccaatcagcgcgagcagccatgccgcggtaagtcccagtgcggtcgaatgaccgacgactctggtggaggccatgacgtcgacgcctatgtgagcaagacgatgatcgccaagcgatccattggacagagcgaacagcaatgtggatgccagtgagatcagcatcgcgctcaggcagaatgccccggcggagtagatcagcgaaaccagtaccgggccgcgggtggacgtattccgtacattcaacggtctgcaggcgaatccttgcggtaggaatacagccagcaggcccacgagcgcagcgatggcgagaggcgcgttcaaggcaacggtacgccatagttcactgctgaccggttcgggcagaataccgaataccggaattgcaggaagctctttggattggccgagccataatgtgaaactggccaaatcaccgatggcgaatccgccgccgaagagccaggaaacagcccagagcatgacgttgggtagccagatcagcatggcgacggtggtgagaattcgtgaaccggtttccatcccggacaattcgaacaacgatacgacagcggcatggttgcgtaccgaccatacgatgacggtaatcaatccaattgccagatatatgctcagtatcgcgacggccaaggcgacgccgattttcaggcagtggcgtatgtccgccggcacctgcttgcgagtccagtccctgaatgctcgcattttggctgattccggtacggctgcgcataggaaaccgatcgagaatacgatggctgctttcagcaacaccagccactggtcatcgacaagacctaggtgcacggattgccggaatgcctcgttcaacccgagccaaacaatcaatccggcaacatacgcatgcggcccgtatgctttgattcgcatgatgagtgcattgatcagccatatcagcagtatggtcaacagcaatggcgtaatggtgagggtgaacgaatcggttctaaagcccgatccctcactcagaagcacaacggcctgtgtcagcgaggttgtgccgacggtgagattgtcgccgccctcttccatagagacgaccaataacatcagcgctgtatagcagcctaatgcaacggcatagatggccatggatgcgagggcgactatggctccccgcacccattggcgaatcacggctttcatcacgattggttggaaccgatcagtcgatgttggccttggcgagtacgtcacgcatgatttcggcggcctggcccggggtcttgcccacggggatgcccgccgcctcgagcgcgttcttcttgtcctgggcggtgcccttgcctccggagacgatggcgccggcgtggcccatctgcttgccttcgggggcggtgaaaccggcgatgtaggcgacaaccggcttggtcatgtgctccttggcccatgcggcggcgtcctgttcggcgaagccgccgatttcgccgatcatcatgacagccttggtgtcggggtcggcttcgaatgcctgcagggcttccagcagcgtcgtgccgacgatcgggtcgccgccggcgccgagacatgcggtgaagccgatatcggacaattcgcccatgagctggtaggtgagggtgccggatttggagaccagtccgagcgggccgcggccgacgatgccgtcggggatgatgcccagattgacgccggggttgccgagcgtgatgagaccagggcagttcggtccgatgatgcgcacgcccttcttgagcgccagttcgacgaagtatgcggaatcggccaccggaatgccttcagtgatgaccacgatgagttcgatgccggcttcgacggcttcgaccacggcggacttggcgaacttcggcggcacgaacaccacgctggccttggcgccggtggcttcacgtgcttcgccgcaggtggcgaacacggggatgtccgcgtcggcaccgttcttggcaccggggaaggtgacggatgtgccggccttgcgcgggttcacgccgccgacgatattggtgccggccttgagcatgcgagccgtatgggtcatgccctgatggccggtcatgccctggacgataacgggagcgccgtcttcgatgaacagcatcagcgaacctccttggactgggtcgcctcaccggcgagctgcgcggccttggctgccgcgccttccatggtttcggacacatggatattcgggttattggcggaggcgaggatatgcagaccctcggcggcggcgttgccatcgaagcgcacaacgatcggcttggaaccgccgagcttggcgaccgcttcgaggatgccgttggcgacttccacgcaggaggtgatgccgccatagacattgatgaacacggattcgacctgagggtcggacagtacgatctccaggctttcggccatgacggctgcggaggcgccgccgccgatgtccaggaagttggcgggcttgatgttggtgccctgttcctcgccagcgccggagacggcatccagggaactcatgacgagtcctgcaccgttgccgatcacaccgacctcgccgtgcaggtgcacgtagtgcaggccgtgttcgcgggcgcgctgttcgaaggggtcgggaacgatgggatccacgaaacgcgcccagccgtcatggcggaaggaggcgttgtcatccaaggagatcttggcgtccaaggcgctcagctgcttggtggattcgtcatccgggtcgccgatcttggcgagcggattgatttccacgagcgtggcgtcgttgtctttgaagcagcgccacatcttgagcagaatctgtgcggcctgatcgacgtccgcgtggtagaagccgatgctctgtgccatttcggtggcagcggccaggtcgaagtcaccgagcgcatcgatgtgcaggcgcttgacggcctccggatgttccttggcgatttcctcgacttcggtgccgccgttagcggtggccagcacgtcgaagtcgcgcgaggtgcggtccacggagatggacacgtagtattcgtgcaggatgctcttggcttcggctacaagcacgccggaaaccttgtgcccgtggatggtcatcggcaggatggactcggattcaagaatcgcctcgtcgcggttatgggcgatcttgacgccgccggcctgaccacgatgaccgatcttgacctgcgccttgattacgcagggatagccgattttgtccgccgcttcagcgacttcatgggagttctgggcaaagatggcgtccggggtgggaatgtcctgttcctcgagcagctgacgcgcctggtattcgtaaagatccatcgatccttccctgactatgtaattggtccggcatgtaactgtacacagtacatgccggaccttgaaaactgactgtacgttgggtgagacgaaatctcaggccggcatcgcgatcagcgagctgctgggcttgccgtcgagcttatccagaccgtcgaggccatcgagccgcatcacgaaactgaagcccaccacggtgccaccggccttttcgataaggtcggtggcggctttggcggtgccgcccgtggcgatgaggtcatcgacgatgagcactcgcttccctgcctgtacggcgtcggtttcgatttcgacactggccgtgccgtattcgaggtcataggattcaccgatggtttcaggcggcaacttgccggccttacgcacggcgatgaaacccttgcccaaatgggcggccatggccgggccgaacaggaacccgcgcgattcgagaccggcaatggagtcgaattcgctcggggacaccggcagggcctcttcaagtgctttgagcagaatcttcaagcccttggggtcggcgagcactggcatgaaatcacggaagatgatgccttccttgggaaaccccggtacggaacgcaccaaggacaccagatattcggcgtcctgttgccctaccttgctcaatgcgtcgatggtgatgtccaactgtgccatagtgctcgccccttttatgcctttgcgatgcgatacgcggatggtgctaccgaatcgaacagcttacttcgtcttggtttcgttgtcgtcaccggtctcgtcagcggtgtcttcctcggacacgacggacgcctcgatcggaacctgaccagcctcatcgttagccggagcctcggtgtcttcgtcgggcagcgggttgccgttctcgtcgacctcatcatcggacacataggccgggcgggtgtactcacgggcgatggcattgaagccgaaacgcagcttggagccttcggagtcgatgacgatctcctcatactgctcgtcgacttcgacgaccttgccgatcacctggccgatggtgatgacctcggtgccgggctgcagattgcgacggaagtcctgcttctcctgctgttgctgcttggccttcttggactgccaccacatcatgccgccgaacacgacgacgatcacgatgagcataatgtactgttgttccacgaaacaactccttcaaacgagcgacattgacgaaacgccgccaagtgtgcaaacaggagaaagtctagaagagcttgctgacatcatctttgggcgtaattcccaaatgctgccatgccttctcggtagccacgcggcctttgggcgtgcgaatcataaaaccttcgcgcacgagatacggctcgcacacggtttccacggtttccgattcctcgcccaccatggccgccagattgttcaggcccacgggtccaccgttgaagttgcgcacgatggcattgagcacggcgatgtccagccggtcgaggccttcggagtcgatctggtacagggccagcgcctccttgacgtcgtccggccgcaccacgatcaggtcgtggacgatggcccagtcgcgtacacggcgtagcaatcggttggcgatacgcggcgtgccgcgcgaacgcaacgcaagctcatgagcggaacccgcatcaaggtttacgcccagtacgttggccgaacgttcgatgagcttttccagctcctcgtgcggatagaagtcgagatgtgcggtgaagccgaagcgtgcgcgcaacgggcttggcagcataccttcgcgcgtggtagcaccgatgacggtgaatcgcggcagggtcagcgggatggagcttgcgcccgggcctttgccgaccatcacatcgacgcggaagtcctccatcgcgatatacagcagctcttcggcggcgcgcggcagacgatggatctcgtcgatgaacagcacttcgccgacgtcgagggagctcagaatcgaagcaagatcaccggcatgttgaaccgcagggccggaagtcacgcgaatcggcacttcaagctcattggcaacgatcatggccaacgtggttttgcccaagccaggagggccggcaagcagaatatggtccggtggcacatcgcgtttgcgggccgcgtccaggaacagttgcagctgggccttgagccgtggctgtccgataaagccttcgagaacatgggggcgcagctcctcgtcgctgaccggctcgttgccgatcggctgggaggagaccatgcgcaacgactcttcgttggcaccggtgttggaggctccgtaatccgttgtctcgctcatcagcggcccctatccatcagcgccaaagccagacgtagcacacgcggcacatcgtcggtggcaagcggcgtgggaatatcgttttcggcgcaagcctcggcaacggcctgttgggcgtcctgctgacgccagccaagtgaaatcagtccttcgacaacctgttccgtaccggtatccaccggagacttggatattgccgcctgagcggaagcaccctcgatctgactcaaatcaatagagcccttaagctcgaggatgattttctgtgcgcccttcttgcccagccccggagccttggccagcgcggtggcgtcgttgtcggcgatggcgtgggccagctgactcggcgtcagtgtggagagtaacgattgggccactttaggtccaatgccggagaccttgatgagttgcagaaaggttttcttggcgtcccgatccaggaatccatgcagggtaatggcatcctgagagaggttcatataggtgaagacgcgggtgtcttgcccggcgtgcagacggctcaggtcggtggcggacatgcgcacttcgtagcccactcccccaacatcaatcaatgcggtatcggtttcgaccgattcaacccgcccggtcagcatgccgatcatacaggtactccttcagggctccaggattcaagactcgaacaactgttcgaaagtatactacatgcctcggtcgtggttgatgcggcggcgcgtggatttctgtgcggcctcagcccactggcgttgcgcggcggtcagatgttgttcgcgttcgccgccctgcaatgcgcctgccgggcgcagcgcatggcaaatggccaaagccaaggcatcggcggcatcggcgggagtcggcattttggtgaggttcaaaatacgtgtcaccatacgctccacctgaatcttctgcgcctgcccgttaccggtgatagccagcttggcttcggtaggcgtatgcaacgccacgggaatattgcgttgcgcggcggcgagcatggcgaggccggcggcctgtgcggtaccgagtacggtgttgcggttggattgtgcgaacactcgttcgatggatacggcatcgggtgcgaagcgatccattttctcggacaggccgttgtagatggccagtagacgcagatcctgggtgatatccggtgaggaccgcaccacgtccacgtgaataaacgaaagccggcggtgctcgccggcttcgatcacgccgaccccgcaacgtgtgagcccggggtcgacgccaaggataatcacgaggattactcctcgtcgagctgggccatcacctcgtcggaagcggtccagttggagtagatgttctgcacatcgtcgaggtcatcgaggttgtcgatgagcttggacaccttgcgggcatcgtcgaggctcaactcgacctcgttcttcggctgcatgacctggtcggcggaatcgtagtcgaagccggcgtcctgcagagccttgcgcacggtgaacaggtcggacggaccggtcacaacggtgaacacctcaccgtcatcggtaacgtcctcggcaccggcttcggcggcggtttcgaacagcttgtcgaagtccacgccctcggacggcaccacgatctggcccttgcgctcgaagttgaaggacacggagccggaggtggccagggagccgttgcccttggtcagggtggaacggacttcggcggccgcacggttgcggttgtcggtaaggcattcgatgatgaggccaacgccggcaggagcgtagccctcgtagacgatgtcttcgtagttggcggcgccgtcttcagcaccggcaccacgcttgacggcacgagcgatgttgtcggccggcatggaggccttcttggccttgtagatggcatcgtacagggacgggttgccgtccgggtcgccaccgccgaggcgggcggcgatttcgatgttcttgatgagcttggcgaagagcttgccgcgcttggcgtcgatggcggccttcttgtgcttggtggtcgcccacttggaatgacctgacataatgctcctagcaattattgaaacggatgatgtcaaacgaaacgattgtaggccgttaatcagacatacccgtgatgtttccgatgattgtcttgttatgcgtaccgataagaccggtcacgcggggtgccgcacctgtgttaggcaagcggcagatgatactgcggagccagctgttcgaatgcctgggcataggcttctcgctggtcggacagcagaataggcatggtgcgtgtctgggcgacgatgggcatgaagttcgcgtcaccattccagcgaggcaccacatgctgatggaggtgagcggcgactcctgcgcctgctacttcgccctgattaatgccgatattgtaaccgtgcggacgggagacggtttccatcaccttcatggcgagggtggtggccttctcgaattcgaacagttcggcatcgtcgagttcggtgatgaatccgacgtgacggtacgggcagatcatgagatgcccgacattgtatgggtagaggttcatgatggcgaacacgtgcgtgccacgccaggcgatgaggccgtcttcgtcggatttcttgggtccggcgcagaacgggcattccttcgtcttgggcttggttgggcgatcctcgctgttgcgcagcacataggtcatgcgctgcggagtccacagtcgttcgaccgtgtcctcctgaggcggaaagtccgccggattatcgacacgcacgtcagtcattttcgcaccctttcttggctcccctctctgaggggagctgtccgtgaaacggactgaggggagtgcgagccatgcaggactcccctcagtcgcctacggagccagctcccctcagagaggggagccagtaccattcacatcactcagccacagcggcgttgaagtcgtcggcggagttcacctggacgcgcttcttgatgacggtgaggatctgctcgcgggccttgtccaccggaacgccgttgagctggctgccgtcacggaagcggaagctgaccgcgttgttgttcatgtcttcctcaccgacgatgaggatgaacggcaccttggacttggaggcgttgcgaatcttcttgccgaagcgatcgtcggagtagtcgatctcgcaacggaccatctcgtcctcaagggacttgacgaaaccggccagatgcggggcgaactcgtcggcaaccggcacgccgagcacctgcacgggggccagccacgccgggaaggcacctgcgtagtgctcgagcagcacggcgaagaagcgttcgatggagccgaacagggcgcggtgaatcatcaccgggcgctggtgggtgccgtccttcgcgatgtactcgagctggaagcgctccggcaggttgaagtcgagctggatggtcgagacctgccaggtgcggccgatggcgtcgcgggcctgcacggagatcttcgggccgtagaaggcggcgccgcacggatcgtcgacgagctcgaggttggattccttggcgacctcggcgagcgtgttggtggcctcctcccagatctcgtcggagccgacgtacttgttcgggtccttggtggacagctcgaggtagaagtcggtcaggccaaagtccttgagcaggttcagcacgaaggtcagcaggctggtgagctcgtctttcatctgctcgcgggtgcagtagatgtgggagtcgtcctgggtgaggccgcgcacgcgggtcaggccgtggacctcgccggacttctcgtagcggtacacggtgccgaactcgaagaggcgcagcggcagctcgcggtaggagcgctgacgggacttgaagatcaggttgtgcatcgggcagttcatcggcttcaggtagtagtcggcgcccggcttggtgatgttgccgtccgcgtccttctcctcgtcgaggtgcatgggcgggtacatgccgtccttgtaccagtgcaggtggccggaggtctcgtacaggccgcccttggtgatgtgcggggtctgcacgaagctgtagtggtgcttgcggtgcatctcacgggagtagtcctccatagcgttgatcacggcggcgcccttcgggtggaacacggccaggccggggccaatttcatccgggaaggagaacaggtccatctcggcgccgagcttgcggtgatcgcgcttggcggcctcctcgagacgggtctggtaggccttgaggtcttccttggtggcccatgcggtgccgtagatgcgctgcatggtcgggttcttctcggaaccgcgccagtaggcggcggcggagcgctcgatcttgaaggccttgatatagcgggtgttcggcaggtgcggtccgcggcacaggtccttccagaccacattgccgtcacggtcgacgttgtcgtagaaactgagttccttttcggaaatctcagtggctgcggccgggtcgaggtgcgcttccttgtcttcgatcagttcgatcttgaagggctggtcagcttcttctttcagtgcctcttcctcagtcacggaacggcggcggaaggactgggaggacttgatgatgcgctgcatgcgcttctcgatgtccttgaggtcgttcggagtgaagggctggtcgacctggaagtcgtagtagaagccgtccttgatgacggggccgacgccgagcttggcgttcgggtagacttcctgcacggcctgggccatgacgtgggtggccgagtgacgcatgattgcgaggccatcttcggagtcgagggcgatggggtcgacggtgtcgccatcgttcagcggcgtgtaaaggtcacggttctcgccgttgatcttgaccgcgatgatgttcttgtcttccgcgaacagttctacgccggtggtggttgcttccacctccttcgcttcgccgttgacggttatggagatggtagcttgcgccatgatttgtcctttgctatcggggcccgcggtactaatgtgcaggcctggactggttaatcaacgtaggacacgataggttgggcgtgcgacaaataccaccagcatctgaaccaatacgaaaaaacctcgccgaagcgaggtttcgttgtggagcggacaacgggactcgaacccgcggtctcaaccttggcaaggttgcgctttactacactgcggaaaaacaccgctcacaaagcggacgccaacttgctaaaacacaaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaggctcattgcacaccccccttgattatggggtgaatgccatagttcgggatagtaatacttataattcggacatgcctaacccctagtagggtcgtttttatccccgtttaagtggagcctgagtagtggctggacggcaactgaacgataatcggcccacgaatggggtatacaggcccatccttcacctcccctacgattgtgttcgcttggcgattgttaccgagcctgcgtgaaacgtttgttgtggtgaaacacaagttattttcgatgcccggccccattacattcaaatcaaaatgccatacattgcccataagattcggagatggcctacaagtcatccgtatgagatgccgtcaatatgacaaatggccgatctgaataatcagatcggccattgttatagctgctcagttataagcagtagtcaagctcacgcgttgagagcgcgcttggtggaacgggacttgacgaacacggtcaccgcggcgcccgcgatcagcaggccgatcacggagaacagcgcggtgccagcggcaccggtaagcggcagctgggtgatgttcttgacgttggtgacctggaaggttcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtagatggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggacagaccgctaacatcgccttcgtacacttggaactcagcaccagtcagagcagcagcgttcttgtcgactttctgccaagtcacggcaccagccttggtggtttcttccttgctgctcttcaggtcaacaacgccggcagcggcgagaacgccagtggcgttgttcacggacggcgcggcgaccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccatcggggtaatgcccgtgacagccaaatccttaagcgcgttcacaaaagcggtggtctgcgcggcggtcagggtagtgttgcccagccaggcccactcgttcagggaatcacccttggtctggtcgttgtaaccagcagcagcgaaggcatcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgttggcctcagccgcgttggcggtggtggcgccgaacgccatgccaccaagcagggtggccgcagcagcgacacccgcgaaaagcttcctcaacttcatgagaaaccctctcttccttattgtgattgattttcttgcaatcgcggaggctgcaaccccacagcaaggcctccgcaatccgcaaatccttattgttttttcggggagggaagccttcatcgactcccctcagtccgccttcggcggccagctcccctcagcgagggaagccaaaaccacctcaagtttcttgaaatcagaccagctgacgcttacgccagaccgtgtagcccgcagcagccagcagggccagcaggcccaggccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacacacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaagtcttcgtcaccgtaatcttggagaccggaagggtgatggtcggcttctgcaggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacatgaccggccaagacacggtgccatcagccgcaaccgtcgcctccggggcgtcatcccacgccgtgatctggccgttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcactgcggtggcggcgacggtggggtcaaacccgctgccgtggttcggctcgccgtcggtgaagaagatgacgaccttcttcgcgttggcgcgaggctgatacgttagcgccgcctgggcgcggttgaaggcgtagtcggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggtcgcgctcacaccggcgacgccaccgagcatcgccacggcggcaacgatcgccactaaccgtttgcctttcctgcccgccgcggcccctaccgctgcgaaccattctgcaattctcttcataaccttgcctgtctcttacgatcacgtacgccaaaacccggcgttacgcttataaggcgttacggtattaagcaaaaagcacgaatgcgtacacccgggtagagggaattttttacccgacactgaaaagaaccttggaatttttaaaaagtggcaccctcgtcatccaccctgcgataacgcacttttcttctcgacggggcgtgccggtcccaccatctgggaactgaggcggatttgccgccgctgcgcgggggccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaagcgtcgcttttggcgacttgagttattatacatatttcttcggggatggcaaacgcgtgtggctgcagcaggaccagccaatctagttgatggattgcggctttgccgaggactcccctcagtcacctacggcgacagctcccctcaaagaggggagctagaaaccgtcgaaatcacaaatggatgagctgggactcgtatggttggaggtcgacgtccatcgcgttcagaatgccgttgcaggcgttgaggtgggcgtgctgcgggtcgggcgagaagttgaacaggccgaccagcgtcttgccttcgtgctgacgaatcacagcgagcaccgaatcattgaacgtatcccacgtggacacccaagcgtcaggcgcgaagcagggatcgttgcgcatcgcgcgcaaatcctccatgcccttccacagctggttctgcaacgtaccggacttcttgcgcagagcggccttggtccagtcgaacttactacggtgcagattgcggctgtcttccacgcgatccgggtcttccttgtaatcccagccgttgagctgggcgatttcgtcgccgcagttgagcatcgggaaaccgcgcaggaagctcatggcgtggtgcatcatgaggtcgcgatccaccgaggtctctagcagtggcttgtcgtgcgtgatgatggccttttcgatgccgcacaggctggcggtggtgccgcaactgcgggcgtcgcgcgtggcttcgtcgtagttgtagagttcgcccatcgaccagctgccgggggttgcgccctcgtagaagtggtacaggaattccttgtgcttgagcgggtcgatgtcgaggtaacgctccacgtcttcgtccaagccccagccgatgtcgtcatggcagcgcaaataattcacgaaccagcagttttcgggcagcgagttgagcttgtcgatctggttcttgagcagacgcacgtcgcggctggcgagcgcgctccacaggttgaccatgatggagacgttgtacagcatgtggcactcgggggcctcgggcgtaccgaagtaggcggcgagctccttgggggccatgaccacctcgcccttaagcaccacggccgggcagacgcattccaaaatgatgcgcagcatgcgcacgatggtgtggacctgcggcaggttgcggcaattggtgccaagctgcttccagatgtacggcacggcgtcgatgcggaatacctcgacaccgaggttggccaggcgcatcacgctgcccatcatggctacgagcaccttcgggttgcggtagttgaggtcccactggaacggatagaactgggtcatcacccacttgttcatcttctcattccaagtgaagttgccgggcgcggtgttcgggaagacctgcggcacatcccggtcgtagcggtcggggatggtgcggtccgggtagcagaagtaatagtcctgatactcgggatcgccggcttcggctgccttggcccagcggtgggtggaggcggtgtggttcatcacgaagtcgatgcacagactgatgccggcgcggcgcagcttcttggccagcgcggcgaggtcttcgttggtgccgagcttcgggtccacggtgtcgaagtcctggaccgcatagccaccgtcgttgttcgggtgcggcatgtcaagcagcggcatcaagtgcaggtaggtgagcttctgctccttcaagtacggaatcttgtcggcaagtttcttgaggtcgccggcgaacaggtcggtgtacatggtcatgccgaacatatcgccgcgcttgtaccagcccgggtcctgctcgcgggttttgtcgagacgcttcaaatcggcgggacggtcagcgtaggctgcggccatgcttgcgacgagtgcgtcgaaggcgtcgtgatcgttatataggctcatgaagagctgttcgagttcgtcttgatgagcagcaaggcgagcgttgaacacggcgctcgaagcgggacgcttggcggttgcggacttggtcgccgctgccttggaggtacgggccgaacggacggcggtcgtcgccttagtcgctgtggttctggccgtacgagacgtcgtgcgcttggttgccgatgccttggttacggttgtcttggttgcttcggttgctgtggaagtcgtagcggttttggccgctcgggttgatgctgtcttggcagccttcttcgccacctcggtcttctcgaccgattccactgcctgtgccgactggttgctttgagccaccggaaaactcctttgtctctatccgttgcccgcgtcaatcgtttgacgttttgcattacacaatatcaaaccggttcgacaatcgcaacccaagactcgccgagccaccggcgctattccacagaaatcgtcaccaccgcggaggcaatcgaaccatcgtggctcagggaaatatggatatgcggcatcgaccccgcaccgagagccgagcgctgcgccgaacgcgcattccgccgctcctgcatcactgcataaggcccgttatcggaagcaggggaataagcagaggaatagcgagcgccggcagccgaattcgcgtaatcagtttggaagactgacgccgcccccttacccagagacacatgcggcacaccacgggaatcatccaagatctcgatttcaggccacgggaaattatcaagcgtgaacggatagggggcatcgccaagataatcgcaccacgctttgaggaacgcctccttgcctgcccacttggcggacagatgcacggcctcgtcatcgttcttcagccgtgcgcgatccgccgcctgacgcacctcacgaacggaaaacagcgagcgcatgcgcgagccgggttcagacagctgctcggcgaatgcggcgacgtcaaccacgtcatgacctaaaccaaatgtgcccatagcacctattatcagccattcaacacgttgacaacacatccagaataacgaggttcacacggaacgcggcatccacaaacggaaaccctcggccgctccgcaagccgaatcctgaaagtcaacaccaagtcaaactgttgactaacggtggacacggcgtaaaatgtcgatattccgcccgacactccaatacgtaaatcgattgacgtcaaacgtttgactttttaacgtggttaacacaacgatccaatgaaggataacttcacaacaaccaaccacaaccagccaatgaagccagcaaggaggtagaaccgtggtcacgatgaagcaaatcgccaatcgcgccggcgtttccatctccaccgtctctctggtgctcaacaaccgcgatatcggccgcgtcagccccgatgtcgccgagcgagtccgcgacatcgccgccgaactcggttatctgaccaaccgtctggccagcgggctgcgcaccagcagtacccgcaccatcggattcctcagcgacgaagtggccaccacgccgtttgccggccgcatgattgagggcgcgcaagacgccgcccgcatgcccgcgttcttcgacaagcacccggatgtcgacggattcttctgcttcaacgacacccgcgcttgggccatctacaccgaggccacccgtcgcgggctgattatcggcaaagatatcgcggtggttggcgtcgacaatcaccaggttgtggccgaagcgctggatccgccgctttccactgtggaactgccgcattacgagatgggctactgggcagtcggtaagctggtctcgctcatcgaaggcgaggcacccgatccctttcctcgtgccggatacccggtcgagaaggttcagccgccgccactgagcgagcagtcaccccagcttgaatgccagctgcgcatcaagcaatcctgggtccggccccgctcccagcgatagcctgcccaaaaatcacgcatctatcctacttgacccggtttcgactgtatatcgaaggcgctattgctgttttcgtgggtggtggttcgttgttgaaccgttgcgggagtaagagacgacgaaccgacatccacgaaaacagcaatagcgtcaaaaaacaatagggtcgggaagaacaccgtaaatgacgttcttcccgaccctaatcgcgagacactcccctcagccggcattcaccgaccggggggagccagagaatatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcaaggtgacgctggccggcagccaggcgggcgttggcacgctcacgccaagcttccagtgcggcctcaccatcggccttggccacggccgcctcgaaggcacccggatggaccagagccacgaagccggaaacatgtccgaagccgagcgaggtggccagaccggccttgaccgggcgaccagcggtctcgcgaccgaactcgtcctcaccaccgccgatgcgcaggggcttcctaacccagaccatgtggtcgtcgcgctggagcttcggatccacgcagtcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccaccgaggccggcagccagggcaccgaggcccggagccgggatcgaggtgtgagcaccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccctcttcaagggagacggctgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcgagttcgagcactgcgccggcgctgaggtcgacggtgccgtccgagtggatgccgagctcggcctgggcgcgcgtacgaccggagccccacgggcccagctcaccgacggaaacgatgacgatttcgtcttccggcttggcagtgacgttggtccaatcgttcaagtcgaccggagcctgcttggtgacgatcggtgtgggcagcgccttgatttgctgcccacgcgaggagtcggacagtccagtggactttccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgctcaacgacggcgaccagcgggtcgttaccgaccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagagtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaaggcggccttgagttcttcactctccgactcgttggcgaaccactgggcttcggcggcgatggtcttgccaaggccgatgaagctgccgttcagggcggcgggatcgttgtcgtagtaggcgcgggcgaggtcttcgcgggcggaagcccaccgatcatcgaagaggatggccttgttggcgtcgaagcgcggagcgacctgcttgggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttagccaggtcgccgccacgggagctggcaccctcgcgagtgtcgagcagcagtgtggcgagcacgctggccacccaaccttcaccgagctgccatacgttggtcacgcggtcgcggatgtactgctgcttgacgccggcggcaccgaacagcgagcgcaggcggtcgcgcagcgcctcggagagcacggcaccgaacggcttgtagttcggggcggccttgttgacgatttgggcgagcttgtcgagcgtcgcttcagcagcaccgtccacgctggcgactcccagctcggagctgatgtccatgagcagctggttgcggcgagaagagacaccgttggtcagggtgtcagtggtgtcgttgctgccgatctggtcgatgcgcaccttggcggagtaggccatgagcacgccgatggcatcggaagccttgaagggcaggtcggcgacggcggcaccggacggtgcgccggccgcggcctgccctgattgcaggccgcgcgaggagtcggacagtccagtggactgtccggcgacggagccatccgttgtctgagcagcctcagtcacggcatttgccggagcggcaccggaaccgagcttggcgacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggtagacgcagggtcttggcaccgaggttggccagggtcggggcgttgccgaggccgacttcgacgtattcctccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcacggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacagcgcgttgtattcgccgagcgagtggccggcgaagtaggcgggccagatgtcggcgccggcttcgcgcagacgagcggtctgggcgaaggccacggtggcgagcgccacctgcgtgaactgcgtcaggttgagcaggccttcggggtggcgataggtcacgccgttggcggtgagctccttcgggttatcgcgcacgaggcccaggatcgagaagccgagcttggagcgggtgagcttgtcggcgcgttcccacacgtcgcgggcggcggcggacttggcacgctcgtccagaaccatgccctgcttctggatgccctggccggggtagacgaaggcggcgcgcggcgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcacccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcggatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtggacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggtgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggcggggttgtcggtgatgtggccgacccaggagatgttcggggacttgcggatgaagtcctcggcgctggtggcctcgccgagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggcaacggagatcgggccggggatggcacgcacggaatcggcggagtagcgctggtcttcggactgccagagctggtcctgaccccaccaacgcagcaggtcgttgtcgatgacgggtacgaacggcatgggcttggggtattcgcgcacgagcaccgggaaccaagccacgtcggtcgggaccaccttgagttcggcggtctgcgggtaggccagtgcgagcttttcgagcgcgggggccgggtcggcgagaatgtcgtcgtgggtcagcaggccagcggcagctgcctcttcagcagaaacgccatcagcggcgaacaacttggaggtgaattcgccggagtccgtgtcgttcacacgggcttcgatgcgctgcagcaggtgctggaagcggtcggcgtaagtcgggtcgacccacgggaaggcgagttcggcgaagcgccgcgcccactcaaggtaggtcatggaggccaggtcgccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccaccgacggacttgccggacggcacccagtgggcggcctgcggggcgaacacgtcgtcggacttggcgtcggccggaataccgggcgtcttgacgagcagctgcttgacttcggggctggtgtgagcctccttggcggtcatcgcggcggtaccgataagcacgccgtcgaccggcatgtcgggcaggccgtaggcgtgggcccactggccggaaatgtagtcggccgcgcgttcgggggtgccgatgccgccgccggcgaccagcacgaggttgtcgcaggcgcgcacttcggcgtaggtggcggcaagcaggtcgtccagcgcttcccagctgtggtggccgccggcttcaccgccctcgacctgaaccatgatggtggtgggggacacggccttggcgatgcgcacgacctggcgaatctggtccacggtgccgggcttgaaactcacgtacggcagaccgtccgcctgcagcgactcgatcagggccacggcttcgtccagctcggggatgccggcggagacgaccacgccgtcgatcggcgcgccggaagcacgcttcttgggcacgatgcgggaggagccgaactgcaggttccacaggtaacggtccatgaacatcgcgttgaattcgaccgtgcggccttcctccagctcgtcttcgagggcggcgatgtggcggtcgaacacttcggcggtcacctggccgccgccggcgagctcggcccagtaaccggcgttggccgcggcggccacgatttccggttccacggtggtgggggtcatgccgggcagcagcaccggcggcttgccggtgagcttggagaacttggtgaccagcttggcgccggccggggtgttgatgacgcgcggggcgaacgccttccagttctgggtgcgctcaggctcgctttccagcatggagagcgtggagcgttcggacagcgtggtggcttcgaccacgccgatgccggtgccctgcaccacgttgccgatcagcttgccgagcgtgttgccggggccgaggtccacaatccacagcttggccgggtcggcgtcgtcgaacagcgccttgacgcgggcattccagtccacatggttgagcagcacttccgcagcgagtgcgcgggtgcgatcctggtcaaagccgcaggcgccagcccaagacacggtctgctcaacagcttcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaagcggccaggtcttccgggtagccggacagcacgtggtggttgtcggagttggtgacggcgatggagatcgggccgcgagcgttgttgacgcgggccaccagcgcctcgacctgggcgcgggtggcgcccttgacggagagcatcgggctggcttcgccgtacttggggttcaggcccagttcgcgcacgcggcgggttccggcggcgccgatcagggcggccacggccagaatctcgtcaagcgtggtgccggcggcctcgatggagccggcggcctcgatggcgcgggtcatgtgcacggcgagcacgccctgggagtggccgagcacggcgagcggcttggcctgggccacgctgtagccgaggtgttcgaggtcgagcagggcgccgagctgggtcagcgccacgccttccacggacgcggtggcgtcggctgcggcgccgaggcgtgccgggttcggggcgaagccgaacaggtcgaccggacggccggtggtggccagcaggtcggcggcgaccggggtgagcagtcggccggctgcggcgacgtggccgcgcagggcctcgtcaaggctgggatcggtggtctggtctgccagggctaccggccacggggtggactggccggcgaaggcgagcgcatggggctcggtggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccggaggccttggccttggccaggtcgtggcggtggatgatgttcaccgcgccggccgcgccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgactttctcggacgagtcgacgtccaggatgccggcgagcacgttcggctggttcgccacgatgccaaccggcttgccgtcgatgcaggcgaagccgacgagcgcggaggcgccgaacagttcctgcacctgcacgaattcgccgtaatcgacgatgcaacgaatcacttcgagcatgtcgtaaggctgacgttcgttggtgggcacgatggtggcaagtcgcttggcggtctcgcgttcggcgcgggtgacggcgtatgcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagttggggcacgaagccgctggcctcgcaagtcttgcggaagatgcgaccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacagcggtgcgcagcggctggtgggccgaaggctgtgcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggccggcgcgtacacgtagttctccatcttcatggattcgagcaccaccagaaggtcgcccttggccacttgctggccttcggacacgttgatgcgcgtgaccacggcctgcatcggggaggcgatgacgccggatttggcgccgtcgttggccgcagcggcactggaggccacgttgtgcagtcccgcaccgcgcaacggctgggtgggtcgcttggcaccgcgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacggcgaacgggtggccatgctcggcggtgaagtcgtcgttgcggaagatttccttgaacagcggaatcggcgtgggcacgccttcgatcacaagctcatcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcaagcgcgggttgacttccaggaagtacaccttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcatccgcaccggtcttgtgcaggatgtcaatcagcagatcttcgttgaggtacgtgtccttgtaggtgtcgccggagagcaggtatgcctcgtcggccatgtccacatagcggctattgcgatcctgttcggagtagacggccacggtggagatacccatctccttggccgtgcgcaccacgcgaagcgcaatctcgcctcggttcgcaatcagcagttttttgacgatagaagccatagtgtcaaattgtgctctctatatagaggagagggcaagccgcgttcacacaaaagctttcacgcccttttgtaggctacgaacaaacgcgcgcgtaggttccggcaacgtaaccgttggcgcctgctatcaaaaacgttgcaaatccgccgattgcacatccttgcgcgccggctcaagaagttgacgttacggttgtgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcaaacgttcgtggtgatgctcgccggtcttatgctgccgtggcgtcaggccggtgccgccgtcgccacctatctggcggccggtgcggtcggcctgccggtgtttgccggcggcacctccacgctggccctggtcggcccgagcgccggcttcctcttcggcttcctgccgggtgtggtggtcatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccggcaggcgcccaaggccaggttcaggccgacgccgaacacgatgacgacgtcgtcatcggcatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcgtattggcttgcgaacaatggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtaatgctgatttccgcgaaatatgcgtggtacatcatcgctctgcaaatcgtgctggctctgatcgccgaccgcaagcgctgggcgacttacgtcgtggcgctgctcatccccaccgtactgattcacggcggcatctccttcgccatctcctctggcgcgatcatcggcggcgacccaatcgaaagccgcggcgtacagctgcaaatgatcgcccgcgtggcccagcgcaatccggacggcatttcagacgaagccaaaaagaacctcgcgcccgtcttcaatctcgatcagatggccgacgcttactcccagcaggacgccgacccggtgaaatcctccggcattcaggccaagaaggtcagctacaagtggcgcacggtgacgcccgaggatatgaccaatttcaacaaggcatggttcgaaatcgtcaaggacaatccgatcatcgcgctggatgcgttgctggccaaatgcttcggatacttcaatgtgaacgatcagccgtacgtatcgatggattattacgtggccagcgattacgtgcagaaaaactccacatggatcaaggattacaaccatgactggcgtgagcacatcgccggcttcactcgcgtatggggcggtattcccgtgctcggctggcctacgcacggcaatttctacgtggtgatgacattgctgatcggcgcggccgaggtgattcgccgacgttggctcaccctcatgacccatattccgctgctactgctgatgggcgtgatgattaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccgcacccggcatcgccgcgaccaaccgcgtacgcaccgtgctgttcgagtgcctgttcaatcatctggccgacgaacgagtggagtccctgttcaccatcctcggtttcgagcatgacttcgattgttacgccatcgccggataccctgcccggtccgccgcacgtacggccaaggaaatcgagaaaatcgtggccgatttcggcggtgtgtgtctgaccgccaagcgcccgatcggcaacagcaccgccgtagtggcgttgattcgtccggtcggtgcggccacgccggaaatcatctgcaataccatcgccccgtcgttcgccgccgatcggccaatcgccttgggtccgcagcgtaccggtgccgatggcgcgatgcgttcgattcaggccacgctttactgtcttcaggccgcgccggctctggccgccaccgtgcagccattgccgcgcccgttacgcaccgacgacgccctgcccgaacgtgcgttgatcggcgacgcggacgcccgtgacgaactggtccgcgtggtctacggaagcctgacagcagcaggccctgatgatccgacgctgctcaccgtctccacattcctgaagttcggcggttcgctcgagaccacggccaaggagctcaacgtacatcccaatacgatccgctaccgtttgaagcgtgccgccgaatccaccggctgggatgccaccgacccgcgcgaggcgtacgtgctgatcaccgccatcgcgctgggtcgtgtggccgaagcgcagcggaccgcagcgtagtcgggcagaagcataaccagcagaaccgtagccggcaaaggccatagctgaccggacataaccgtccagcccgacagcctagcgggccgaatcaggctgcctgaatctcgtgtacgccatcgtgcagtaacgcggccaaggattcttgagtggctaacacttcgtccacgaatccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcgacatcggcatcctcgaaatacgccaaggccacgcggccggccgcgccagcatgtagaggcagcacgcggcccgggcgcaggatcagcgaatcgatggcatgaccttgcgcgcattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagcgataatgagtagttgccatccgtatccgttacggcccaccccacatcgaccagtccatccagcacacggtatacggaggatcgcgggatatcacaggcgtcggcgatatctgccggcgacaggccattctccgccgccaatgcgtccaccacacgactcgccttgtctaaagcgcgggtcggttcacgtttgtcttccgccatcgtcgacgttccttcccctgacttatccctgactcatcgtattcaactgttcaggccaagataatcaccactgtatccaaggcctcgcgacacctcgcggccggcagtctgcaccaattgcaccatgtcttgagccgatgccgttgccggtttcccatctaccagacaggccagctcaggttccaaggagcgggaaaggctactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatgcacaccgtgcgcaatcgcctccgaacgaacagaccccagatgccgaactggccgcgatgggcgcggaaggtacggcgagcgatctgctgaatgtccagtctgctttcgatttggccgccgatacgtacgcaatcgatgccaagccgatactcgccacgattgatgccgcgttccgcccaaccgactgcggcgagattatccagcaaacgatacgttgagcttacgggttcaccagtacgttcgcttatggtttttgcggtgcttggccccagttccgccaatacatcaagtactgccttggatttcaccaatgcatctacgcttcggtcatcacggcttgacgccaccatgcgcgtcacctcctgacctgtttgttgatacctcagccatcttaccgggtattcagcgggttgccgcccaaaacgtactgggccccggcaggagtatcccgtcggggcccaagaggtttctggctcccctctttgagggggagccgtccgcgcggcggaccgggggaggcccgagacgctaaggcccaaggacgcgagaaacaccccgacgcgcgggtgtcctgatatggggaaagccccttggggcgtgtgctccgaggggcttcctgtacgtgtggtgcggcgggcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcatcggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcgttgcccccgtgcaggtcgcccagatagcgggtcaagcgcgagcgcacgcccacgagttcgtcggccagctggtcgaatcgctgggtggcgactccgggctggaatccgactgcggcaatcagctgcttatcaagcgcggcgttggcgtgttcatcggatacatccagtacctgcgccttcatctcattggcggaagccgtctggatgaacagacgcttctgctcggccacgccgggcacgtacagcacggaacgaccattcatcaggcagcgcgatgcgatggccacagcctgctccgcggtgcccttcgggaaggtgccgtcgaccacgatgctatggccattggcagcaagtgacgcggcatatcgcaccgtattgtccacatcgccgacttcgtactcggcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggccacgcgaccggtgaatcgaatggtggtcgacaagccatcaccctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatactgcggtattggtcacgccagcgacggatgcgattcagaccttccgtgagattctggttctgagtctggctctgggtcatctctcgactcactttccaaccgcttcgcggtattcctgatagcccttgttgtgagacaaggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgtggagtcgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccaccacatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgcaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcccggaccgaggccgtgccattgctttttaccgtgaacatggcgtgccgtttggacatcgatttggtttgatcggcgacgtcaaggcgggtgttgccatcatcggcaagggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcggcagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagtccggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtcccctgagttgttccgaattattctggcagtcagtctactcccggacccgttcacgttgcctccacaagctataatcggccacggttctgattgggtgcgcagcgcctgacgcgcgttgggcaggccgatcagggcgagtcgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaactttaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggcacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcacccgagagaagctagagaacgatcagtcctcgaatgccgaaccgttaagcgggaagccctacgggcttcccgtaggtgagggagcggctatgccgcgaccgatccgtgagagggctttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcatcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcagtgccgggggtgaggttcacgaaagcgccgaacgacgtggtcttgacgaccttgccgttgtaggtttcgccggcctcgggcacgtgcgggttggcaatctggtcgatgatggccttggccttctcagcagcctcgccaccctcggaggagatgaagacggtaccgtcatcctcgatggcaatttcagcgccggtgtcttcctgaatctggttgatcatcttgcccttcgggccgatgacttcgccgatcttctcaaccgggacggaggtggtgatgatgcgcggagcgaactcgctcatctcggccgggccgtcgatgcactcgttgatgacctcgagaatcgtggcgcgagcttccttggcctgctgcaaagcggcggccagaatgtcagcggggatgccgtcgagcttggtgtcgagctgcagggcggtgatgaactcggaagtgccggccaccttgaagtccatgtcgccgaaggcatcctcggcacccagaatatcggtgagggtcttgaagatgtgcttgccatcaacgtcgccggacacgaggcccatggcgatgccggcaaccggagccttcagcggcacgccggcagccaaaaggctcagcgtggaggcgcacacggaacccatcgaagtggaaccgttggaaccgatggcctcggagacctggcggatggcgtaggggaactcttcgcggctcggcagcaccggcacgagagccttctcggcgagggcgccgtgaccgatttcgcggcgcttcggggaaccgacgcggccggtctcaccagtggagtacggcggcatctcgtagttgtgcatgtaacgcttggactgcggaccggacagcgcgtcgatctgctgctccatcttgagcatgttcagggtggtgacgcccagaatctgggtctcgccacgctggaacagggcggaaccgtgcacgcgaggcacaatgtccacctcggcggacagggtgcggatgtcgcgcaggccacggccgtcgatgcggtagtcctcggtcaggatgcggcgacgcacgatctggcgctgcagttccttgaaggcgttaccgagttccttgtccttctcggcatcgtccatatcagtgaactcgtccgcgagcacctcgcgcacgtgctccttgatctcgtggatgcggtcctggcgcggcagcttctcggcgatggagagggcctcgtccagatccttgtgagcgatctcgtcgatgcgggcgtacagctcgtcggtgtactccgggaagagctggaattccttggtctccttggcggcgatcttcttgagctcgtcctgagcctcgcaaatcaccttgatgaacggcttggcggcctcaagaccaccggcaacgacttcctcatcgggcttggtctgaccctcgtcgtagatgaggtgccaggcgttcttgccggcaccggcctcgatcatggcgatggcaacatcaccgttctcgatcacgcggccagcgaccacaatctcgaacacggcgcgctcacgctcgctccaacgcgggaaggcaacccactggccatcaatcagcgccagacgcacaccggagaccgggccttcgaacggcagaccggaaatcatggtggaagcggaagcggcgttcagggcgatgacatcgtaagcgtcatcagggttcacggcgagcacggtctcgacgacctgcacttcgttgcgcagggtgtgcgggaacagcgggcgcagcgggcggtcgatgatacggcaggcgaggatggcctcggagctcgggcggccttcacgacggaagaacgagcccgggatcttgccggcagcgtacatcttctcttcaacatcgacagtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttaccaaacgatccattgtcgattacggcctcaacggccttgatttcgggaccctccatagggttcctccttctttaattttctaattattcctacatactgtgctgcggttcggcgactcgcttgaaccgcaactgtcctcttcagcggacgtcacataccttgtttcgactgaccccttggccgtcgttcctcgtgtcaaccccttcattcgggttctcctgtcggccttacctgctggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgcccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacatcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatactttttggcttcgtatttggagccatcaagcaaatcagtggtgcgcagcagcatcaccgtacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaacctttcatgataagcactcaacatcgagtgcgtattccaatagcatgcccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatcgtcattggagccgtcggcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggctggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatgacctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactccccccccccatcatttttttcttcgccgcacaatcgaatcccacgttggttacgaccacatcgcggctcattgcaaagccatgccagaggaacgtccctcaagggcagccatgcaacagccattatataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagactcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctagggttggaagtgttcgaagagttacccgttcaggtgagctcctgcgactgggcttgaaccagtgaccgtccgatatacggttctggctcgcagccgtagggctttttgcaacaggagtagacaatacaccagccttgctgttccttcaaatcggcgtgtcatcgcgcatgttcaccttgcagctggttttccgaagagcatcggccagaaacgcgcaatagtattccttgggaagtgatgaagaagtcacttcccttttctatgcgcttaaggagccccatgaggtattggaacgacaacaggaagagctgcgaacacgtcgagccacgggaggattggaaagaatccattgagaaatggatcgactggatggacgccatcggacgcacgaacgacaccctgcgcacccgctggtaccagatcgttcgattctccaaagccgtcgataaaagcatcaccgacgtgaccgaagacgacctcatattctacctagccggcatgggaaccgaaggcagacgcggagtgcgcagctgcgtcaaggtcttctaccaatggagcatgaagcgagggctcgcccgccgcaatccggcggacgaagtgcccaccgtgcccatgacccttccgtccggctgcatctgtcccgaggagaacatcgaacaaggactcgcatcacccgacgagaacgcgcggctggccgtcatgctgggcgcgttctgcggcctgcgccgcatcgaaatgaccagaatcaacctgaagaccgatctggaggagaacgccgagggcatggtgctccacgtccacggcaagggcaacaaggagcggatgcttcccgtgccggcaaagctcgcttcggcattgcggaaacgcaccggcgtatggctgttccccggagacgtgcagggacactgcggcgtcgattacgtggcgaagaggatcaagacggtaaccggatacccgtcgcacagcctgcgccgtaggttcgccacatgcgtctactacaggaacggctgcaacatcgtgcttgtcagccgtatgctggggcacgccaacatcgccaccaccatgcgttacatcggcctcgtgcaggacgagatgcgcaacgccgtggaatccaccacccgcaccgacatgagactgaccatgcccatgaaccaggtcgtcggaacagccggcagcgtcgccacctattcccttagcaccgcgaggatcggatgaacaaacagattcgataatgcagaagttccttctcgaccacgggaagcagattgcccatgccttcggcggaaacgatctgtgctgccatggctttgtacttgaacggttcgtcagttccagtcatcgtcgtcctccaattcgtccatgtccaccagatcgaggttgcgtccgacggccttcaggtcacgatacgcccactgtttcgacgcgagcggcgtcagtccgtcatcgcgggcgatcaggttcggcaggatgcgactccagctgagcttgcagtgcgtgaactcgatcaccccgtacgcggtgcggaactcgccctcacggcccgtggtcatgaacgtgaccctatccaccggaatctggctgatcacgttccagcgcgacagagcgctttcgaggctttcccacaccagctcgccggaacgcaaccgctttgcgacctgatgaagtgtcccctcgccgagatgggaggaatacgcgaacacgtagacgccacgggcggcacggaccaacgccttcgccgataccaggctggacagggttcggttcagtttctgcccctgctcacccagcacgacggccagttcgttcttgcaatacacgtagcacgagtacttggcatccatctcgcgcagctgatcaatcgcctcgctcctcttcatgcatataagtgtacatgaatatatgtaaaaacgcatattcatgtacacctatcacaatcctgaagcgttccaatcagagggaacgccctcgtgccggaccgtcttcgagaccaatcccgtcgatggcgttttccgagaaagggttctctcttaatctgccgacgatttccgctacggcgcgctcttcctgatcaacgcattggacaagctgggaaatgaacggcttgggatcgccgtcaacctgccatgcttccagacttttcccatagctgcggccggcatcatgtttgattgctacgggccggtagccggcagccatgagcatgagattcagaatctgtcgcccggttcgcccgttgccgtccgtgaatggatggatgttctcgaacatcgcgtggaatccggcagctttgaggatcgggtggtctttggaaccgttcaccgcgtccacgagcgcttccatgtcctcgtagatttcaagtgggtcggcggtcttcactcgggtggcggtgatccttgcctggtagccgtaggggcggaaccgacccctgagcgcgggctgcatgtccaatgcggtgacttcatgcagcttttggatcatctcgacactcagcgtccgctcctcttcagcgaatcgttccgcataggccatgccatccgcaacgccacgggcagcgaagatgtatcttgccggcgagtcggtcggcacgaactcgccctccaacaccagttcggtgtcctcaagcgtcagcgtggatccctcgatcgcgttggagttgtagacatagcgggccatccattccttacggtaatcctcaagcgctgactgctccaccccatccaaaggaaacatctgcctgaaccgttctcgggcggcatcggaacgacgaagcaagtcggacacctccgcgtcccgctccagagagtccaagagaggaggaaggtttcggattttctcagtcagcgctggattcggcatatcggctccttaatcgatgcttccataagtctacaagcgcaggcgcgtcacatggacagtccgacgattttcttgccttcgagaaagtcctggaaaaaggccgtggaatcatcgttgtcgtccgatgattccatggcccttatccgtgtcgtttcttacgttcaccgggtcatgccgtatgacgatgactgttcgaggttcaacgggtcggccggatcgcatgcgccggcggaaagctcgtctttttcttgtttcgccggtgtcggttcgggcatcgcggcgagcttgtcgaacgtgttgaggaacgcgcctatctcgcggtcgctgctgatggggtccatgcccctggccttcgtcagggcgcgtatgaagtcgaggtgattgtccgcgaacgcgccgaaacgttcgaaatcaccgcccttgatgctggtcgtgtcctgctcgtacaggctcgtatattcgtcgcccatgcgttcggcgaagtccctcaccctggcatcgatgtcccattcgatgggcgggcatccgaacgcgagttccacgtaccggggttccacggacaggccccgatcggttttcaggtcgttccagaagcggtccacggattccttgccgccgtcgtagtggcggcctgcggcgtcgaacggttcgccagcccatgcctgttcgtaggattccaatgcctcgcatccctggtcggtgagctggcgtatctccacctccacactgccgtcgtggtggtggccgcgcatcttcaggattccgttctcgtcccagatgtggtcgatctcgcagtccttgaacggggaatcatcgccgttcatcagatcatcgaaggtctcgaacgaggatatgcccgtgcgttcgccgtcccatcggcctatgcttccgaacgcgatcagcgggttgcctcccatcgggttcctgtacgaggagagcgccgactgggatccattgaagaaatcacgcagagcgccggtctccatcctgtaatcggtttgacgggattcgtccgcgaaggcatcgaacgtgatcgacgtgccgctctcctcgtacagccgccacaggctgtcggcgcgggtgctgtgttcacggtgatacgggtccccgtattgcgggtcgtagtcgtcagcgttgtagatgtaccgtttgcggggttcgggatcccgaatctcgtcgatccaattcatgtccatcgtgtgctccttggttctgttcgtcgttgccgtacggcgtcagcggccgtgtgtcgtttccatgccgtcatccaacgcgaggtcgagccctgcggtctcaagagacgtttcctgtgggtcggcccagccgacggcgaggtccagcgcgccgcgcaacgcctggccggaaagccggtacgtccaggaatcgtttgcctcgtaagggaaggattcgccggacacgatgccgcgctcgtcatgcaggctcacgtcgaacgttccgggtttggccgtgatcagcgcatgacgggcggaaccgggagccgagacctccagcgcctttctgccgtcgggagacccggtggcggtgaatttgatatcggggtggtgcgcgaggctgtaggaagcgttggactcacacgccagcgggaccgtatctcccagcccgctgtctgcggccagctgctgtgggctgtaatccatgccctgcgtgtagtcgatgggctgcgcgtcggtgtagaagcatccgccgccatcgtccgcgtcgatcaggtcgcccacgagccggtccaggcgtgcggggtcgtcccatgcgctcacgagtctggcgggttcggcctggttcttccatgccatgtagcggtcgcgttggtcgccgcagatgccgtcgaatgattcctgggagatgaacgtgccgccgtccaattggtagcattccccgtccgggtccaacgcgcgctccttgaactccttttcggcggcggcgtacaggcgcttgtcgagcggttccatggccgcgtcgatgcccgccatcatctcgtccacgtgttgccgcatgtcgggctggctcgttttccaccatgcctgcaagtcggcgagcacgtcggcggcgttctcccgttcgcacacgtcgagcaggtcatcgtcgtaattttccaccgtccaggagtagaaatcccagtcactcgaaccggtcaggcgttcgatgcccttcatgcggtggaagtccatcaacccgccgccgtgctcgcgcacgatgcccgccaacggcagatcggcctcgtccatcaggcctttccagtattcggggacattcccgttctccatgtcgtgctcctttccgaacgccttttcgatcacgagcgggtctcgtgggtcaacagtgcggtcgatccgcagtatctcgggcatgaccgcctcgctttcacggccgatgacgaacgtgccgataccggccttgacgcgatgctcgggaagccttcccgaaccgtcgcacatcaccgccggccggaacagcgaatccccgtaggcgagcgtcaccgtgtcgcccggcctggcgagaacccgttcgacggccatgcgtgagaggccgtgcgcgtcgagacggccggaacgccaatcgttggcctcggctgctgtcagggtgaaggaaacggaacgccctccccgggccgaggtcacgtcgagcctgaccggctgcatggcctcgaaaccgatccagatgccttccggcgtcctgtccggggctttcacgtcaatgtccgtgaacccgtattcggtcagcacgtccgtgaccctgatcctgagcgcgttgtcgggaggcagatcagggcgttcattgggaatcgggagcgaggacgcctcgaaccacacgtcctcgctcggatcggtgtcgaagccgccgtccgcgtcggaatacgccatgtggacgccgaactccaattccttggcatcgacggaagagaccagaatcgcgttccccagcacgagatcgcgcgcgttcctgcgcaggatggattgcatgtcgggcttggcgggattcccggccgcgagcaggtcgcggttcacaccctccatgtcaaaaggcgtcaaggccatctcgctcgccctttctcacttggaaaggccggaaccggccgtatcggtcatattcagcgggtccgaggggtcgcacgcctgcgcgcgttccgcgaacgaggtgacggcaccgggcagcacatatcccagatcaaggtcgatcgggctcacgccgtcgtcttcgccgacggacgctgcgggcattgcgcccatggtctcgcgcagcacgtccacggcgtcgccagtagcggcgcgcgcgtcgatgatccggtgcatcgtgtcctcaagcgcggcatggatatcggtggaaccctcctccacgatgcactggtatgagggggctccccagttcgtgccggtgccggaaatcgtgtagtccgcgatgcgttcgcccggctggacgagcgaggcgaggtcgaacgcggccggcgaaccggtcttcgcgtcgaaatcatccagccattcgacctcctcggcgatctcctcgcgcgagtaccggccgtcgatatcgctcggccagtccgcgtcctccagatagccgttgtcgccaagcgacacatcgccgtcgagcttgaggtcccggccgtacatctccatatcgatcagatagccgagccccgtatcgaacatggatcgcacggcatccgatgcccacccatggttcacggcggtccaggcatacttcgcctccttcgattcggccgaggacggcgcatcataagagtgataggggatctcgtccgagttcaacgcgaggttcgcgtactgcaacggggtgcgcgggaccgcgtcaagatcgtcgcggaccgtccgcaccttctcgtacacgtccgggtcgtcgtcctcgcgcgcctcgaacgcgcggcacatgaggttcaggtccgtcagcgactcgtattcgccgggattcgccacggtggcgagcagtccttccccgccctcgtagtcgtggatcgcgtactcctcgtaccggccgcccaatcccacctcggtcttcagggtgtcctgcaagcgttcggcgggcatgggcagcgtgatccacgcgccctgcaacacgccctccgcgtatttgcccaggttggcgacgtacacgctgatctggtagtccttcaatccggccatgatgatgctccttcgctcgggtcttttatcgtgtggctgcggccgaggcagacgtatcggcaatgctcaacgggtcggccgggttcgcgggatcgtaggtttcggacgtttcggccttctcgccttcgtctttgcgggcgagccggccgtcgtccaccatcgcgtcgatgatctcccatccctcctcgatgctgcggtcccgcaattccctggccgagatcatgtcgcgcatcgcgtccatgttctcgttgttgtcgggccagtcatggtctttcagccagtgccgaaggtcctcctccgtccagcggatctccgcaatcgtttcgttgccttgcccggcgttgctttgaccgggatgaagcaacgcctcagatcggagaccgaaatacgctttgtcttcctggaggccggacaggaagccggagggcgtgaacccgttgcgtgccgcgaactcgcgggaccagcattcgtcgaactcctcgtcggggtcgaagtcgaggagcccgtccgccatggcgcgcctcagccccttctcgtccgcctcggccggcaccgtgaccgtgaccgtggcgtggttgggggcctccagcgtcatgtacagttcgctgtggccggcgtcgcgttggatgaagcattccccgttgccccagtcgagctcgtgctgctcgatcagctccttcgccttgtcggtcagggcccgttcctgggacgtgtattcatcgggttccatcagcatgatgcgtccttccttcccttggatgatcggtgccgcgccgtccggcgggcatggctccgatcatcagcccatacgggcggtcgcgcggggcatggcgtctacggggcagatgattccgccgagatttgatgctcggtccctttacgtgtcccgcccctcagtaccagttgtgggcgagccagaacgtcttggcggcgccggggctgccgtaccggccggcgatgtagttcaatccccatttgatctgggtggcggcgttgtccttccagtcgtctcctgcggaggcgagtttcgacgcgggcaacgcctggggtatgccgtacgcgccgctgctcgggttggtggcattccactgccatcccgattccttgttccacagccatacgagcgcgtcatagtcgccgtctccccagtccttgtacgaggcgatcatcttccgggcgatggcccgggcctgttccggcgtggcgtgggtgccgtcgccgtcgtagtccaccaccacgtccgtggagcccgagtcggaactggagcacgtccatgccgcctccaccggatccgaagaggaggacgagtcggacgatgacgacgaatcggacgattcggaaccggatgacgtggaatccgtgccggcggaaccattggtggacacactgccgttgggcaggatgtagaccgcgccgacgttgatcctgtgcgtgcggtggttgacgatgcccaggccgccgcgcccgttcatctcgctgatggtcacggtgccggccgtccggtcgaccgcctcgacgacggcgacgtggccgtacagggtgtccgcgtcggccacgccgggcgggtagctgacgatgctgccggccacgggatcggtgcgggtggtcttccatccggcggcggtggcgctggcggcccagtcgccgccgttgccccagtaggagcccacgtccaatccgattttatggcctctcatgcacgcccaccatgtgcattgcccgtccggataggcctggcacacgttgtcgggcccgtcggatccgttgaaccacgccttggtctgcgcgatggtcatgccgtcacgcacctcgccggtcgtgacgcttcccgtgacgcctcccgacgatccgttggagccgccgtccttgcagccgccgaggaccgcgagcacggtcaacggcgtgcatccgccgagcagggacagcaggcacgccgagagcatggccgcgaggatccgatggcggctggcccggctcattgcgtgttcctcagcgaccagaagggcttctgcccgccgaccacgacctccacggtccggcagggatgctggaccgtgccgtatccggtggcggagatcaccgtgtacgcctcgtcgccggccttcacctgatcggggtcgagctcgttggcatccttgtccagcaatgacgcgtcgagcgcggccgggcagtagacggtgacgtgccagttgccgtcgtccatcggcaagagcacggtgttgtacgcctggctgacggtctgctgcggatccgtcgtggatgacggtccgccgccttccgggatcgggaagctggtttccttcgtcgtccagaacggctgggactggatggcatccgtatccgagccctcccatttgccgtcggaggtgcaggtgtaggcgtagttgacgtacttgtcatcgtattggcccgagcatacggatccggcgtggaagcggcgctgggtccaccaccagcgcggcgcgtcggagaccggatggctctccccggcaccgtcgtcgccgagcagcgcgaacacgttcttgcgccattcgtcgtcgctgccgtttggatcgagcagcgcgtccaccgtttccaatgcggtgtcgatcgggccggaaccattgtgcagcgtgatgccgtccgcgttttcggagagcgtgcgggtgccgtccttgtgggtgtcaacggggaacgcggtggtgcgctgagaccagtcgccgggaaccgggattcccgccgcctccaggccggcgtgccgtcgcgggcccgaatccgttttccttttgcccgtggactcctgtttcgcgtccgtcgcggaaccgtggtcgtcgccggccgttgacggctggtggttggcgacgatgacgcccagcgagcacacgaggagcgcggcgacgaacaggcacaggacgcgcagcggtttcggcagcggacgcggttccggccggttcacgattcaccgccttcccaacggttcggctcacccggcatgccgccttgcgtgttttcttccatggccggatgctcccgctcggggttcacggttcccggatccgcgttttcgggcgacccgtcttccgccgacccgtcttccgtccccgtccaccgcgcgtctatgaggtcgtccgccgttttcagttcggcgctggtgtttcccgcgtccttcgccttcctgcgcagcagggtggccttctcgcgggcctcttccagacgttcctccaatgatttgatgttgacgcgcgccgccacgtactcgtccatcgcatcctgtttcgtcttctggctgtcgcgcaccgccttgaggatgctgcgtttcatgtcgcgcatggtgttctggttgttcgccacgacgatcttcctttcgctcgtttttccgtcaaggcgagtctgccttcccgtcgcgcgttccacggggcatggcgtctacattccccatggcggaaggcggggcgtgtagacgccgtgccccgtggccggccgttttgcggccgagaatcggaagcgtcgttccaatcaggtgaaaggaaaatcaatggaatcgtttctctctatgctcgccggctggttcatgggcctgtggacgtggctggtcgagctcaacgggatgctccaggtggtgctcgtgctgttgtgcgtggtcgcctcgggcgtgtgcgcgatcatcggcaaacgcatgggcagcccgatgatcgtggaatccggcggacagacctggagccgcacgctggtgacggccatcgcgtggatcgccggcgtcatcctcatgctgatcgcggtgctggccatcgccgccgtgttcgcgccgctgctcggcttcgccgcctgaccttggcgacgcctttccatccagggccggccgggaagggattcccgcgccggtcctcgcatgtcggacaagaatcaaggaatcccaaaaaacggaaggaacgcgaacgaagaatgaagctcgtcatcgcggaaaagaaatcggtcgccacggccatcgcgcaggcgttgtgcgccgcgcccgtccaaagggacggatgctatgagtgcggccagctgctcgtgacatgggcgcagggccacctgatcgaccttgccatgcccgaggactacaaggacagggattggaggaaatggagtctggacacgctgcctgtggacccgtccggccattggcggtggaagatcagcgaggagcgcggtgccggctcccgctaccggcagatcgtgcaattgatccggcgcgcggatgtggattgcctcgtcaacgcctgcgaccccgaccgcgagggtgaggccatcttccgccgcatcgcggacatggaaggctcgcgcaagccggaactgcgcctgtgggtggcgagcctggaggcggaggccatccaggccgcgtggcgggcgatgaaacccgaatccgaataccaagggctcgcatggtcggcggagatcaggtcgaaggcggactggctgatcggcatgaacgcgagccgcgcgtactcgctgctctacaacgcacggttcagcgtgggccgcgtgcagacgccgacgctcgccatgatcgcggaacgcgaccggcagatcaggaaccacaaaccggtgccgttctggaccgtgatcgcggacatgggcggatggcggctctccagcgaacggatcgacagcaaggatgcggcgatgctgctgtgcggccaggccgaacgcggccgcttccgcatcatgtccgtgaaccggaggcgggtgaacgaccggccgccccgcctgtatgacctgaccggattgcagaaggacatgagccggttgcacggcatgaccgccgcgcgcacgctccaggcgttgcagcacctctacgaactcaaactcgccacctatccgcgcaccgacagccggtacatcacgcatgacgacctcgaaacgctcacggcgctcctcgaatccggccgtctcgcccacgggttcgtcacccgcgagggcatacccggacacccgcgcccggagctggccgtcaatgacgcgaaggtggccggccacaccgcgatactgccgaccatgcaattggacgccgggaagctggaaggcctggacgatgacgagcgcaaggtgatgacacgcatcgtgcgccgcatgtgggaggccgtgggcgacgaccatgtgcacatcgtcaccgaggtgaaggcccggctttccgacgacaccgacagggagttctccagtcgttccgacgagaccgtatccgcaggatggaaggccgtcgaaaccggccacgggcccgaaccggaagacgaggaaaccgcgaacccggcgggaggaaggaacgtgatcccatcgaacctcatggaaggcggcgtcattcgcccggtcgggaaggtcacggtcgaggaaggcgagacccggccgcccaaaccgttcaccgaggccacgctgctggccgcgatggagcacgcgagccggtgcgtggaggacaaaaacctcaaggcggcactcgatgacgacgaatcacattccggcggcatcggcacacccgccacccgcgcggacaccatcgaaaagctcgtgcgctccaaactcgtggaacgcaagggccggcaattgcacgccaccacggaaggcgaacgcctcaccgacgtggtggagccacgcctgaaggacgtgctgctcaccgcacggatggaacaggcgctctccgacgtggaacacggcaaacgaggcccgtctgaggtgatggacatgttccaccgggaggcattgcgaatccccgccgacgcgaccgcgaacctcaaggccgatgccgtcacacgaaccgcgaacaccgacgcgcaggattggggcgactgcccgcgctgcggccagccggtgaggaaaaccggccggatgtggcagtgttccacgaacaagaccgagaagaccaaggacggcaagtgggccacgaccgcaggctgcggatggaagatgttcgcgcgcatcgcgggcaagaccatcaccgaccagaccgcgcgcaggctcctcgcgggacaatccgtcaccctgaagggcttcacatccaaatccgggaagaagttcgacgcggccatccgcatcgacaagttacgcggcacggcgttcgacttcgaccgctgaccaaccggccaaccgtccgtgcccgacgcgccatgccgcgccgggcacggcaacgaccaaggagacgatgaaaccatgcgacgatacagccacgccttccgggtcctcatggaccgggagctgttcaatctgcttgccgaggcctccaccaagacgggcatacccaaatcccgtttcgtgagatacgccatccagccgttcagctacacggaactcgcccccggcaccaccgattggaacgacgtgtaccgcaccgaccccgaccccgaacatccgctgaagcggggacgccagctcaatgtcatgctcaccggcgacgaatacgagatgctgtgccgggccgcgttcaagctgggcatcgcgcgcagcgcctgggtgcgggaacgggtgtacgcgctcctctgccgctcctatgcggacgagctctccccgctcacggacgcgagcatccgcgacaacgcgacgatgctgctcaaggagctcaagacgaaggatgcgggaagatgacattccaaaaaaaggaagagccccttcccattcgtggaagaaggcatcaccccgaacgatcatccaccctcatgcgttttcctatgcgctcgtatggatatatccatggacacccacatggacacgtctatggacatccacatggatatgtccatggacatccacatggagatgcccatcaaatcgaaggtaagcaagctagacggttcatgtacatgaaccgagcccgcagcctcccgcgccctacggcgctgaagcaacaacccgagtgccgaaggccgatggaggaggagaaagaataatgcgtaaaagaagcagcaaaggcggcggcgcgcagcgctccatccaagtgcatcttatggtgaacgaagaggaagccgcgatgatccgcgccgccgcgaggaaacggaaccagacggtatccctcaccatcatcgaagcggtaaagctgttggagggaagcctgtacgtcgaggaggaggaacatgattcgcccaccgtccaggcgctcagggagatcgaataccagctgcgccgcatcggccgcaacgtcaaccagatcgcgcacaacgcgaacagggagatgaacgcgaccatcgaggacgaggcatcggcgtcctacgccgtccggcaatgccgggagctgatagaccatctcgatgccgtcatcgggcagtccgggggagtgcctgatgacgcgaaccggtcagaggagggtcaggctttgcggacggtccgcttgtagtccttggatttcttcgatgaaccgggagaacgtcatggtttctccctggatcaggtcgtcataggattccttgactaccttgggcatgaccaggtggatgtgcagttcatcgagttgggcgagcttgggatgggtcacgtcgccgggagtcagggtgaacaggtgtttgtccctgatccggttggcttcgtcggcgacctggcggaaacgatccttgatggaggttttcgaggcgagcatacgcagctgttcctcggggaacgccggatcctcgtaggcggcttgcgagggaaacaggaaatcgggtttctttccgttttccgtcttggcctgcgcctcgtattcgatgccgcgcgcgtcgaggatgtgggcgatgtggatttcgaggaccttgcctgcgcggctcatgcgccggttgcgcacggaggtgtagaacgaagtgaacgagtcaacgtcgatgacgccatccgatacgaatggcgcggcatcgtagtcgtgttggatgaccgcccgctcatagagtttgaacagcaggtagctgcggtcgtagtattcgatcaccacgtcgtcagggtcatcgtgcgtggggtccacgtccgtcaaggaggattgggagaaggccgcgaactcctcgttgctggggaacctgtatccccatctgccgatcatctcggggagatacgtgtcatcccgcacttcgacgttgatgccgagagcttcgaagatctgcgcgccgaaggcgtccagctcacgttccgtattgtcgtggaagcggaacgcgccctcctgttcgtcgtcgatgccgaagagccatttggcttgggcttcggccgtgctgtcatgctgtgcgatgatgatcagcagacgattgtccctgagcataccgaagcacatgaggtcgccggggcgggccatgcggattggctcgcagtccttgtagtagagacgccattcggcgctgcgattcgggttgttgcgccgcgcgtcgtaccatgtggtttcgaggtcggcgaccgccggtgcgtcatcgtcgctcaggtacatgagcgcggtgggtatgccgtgcccttgtgaggctctacgatcctcgccggtgccgagcagtcttctgagcgcgtcgttgccgccgaactcgtgctggttgctgctgttggcgtcgatatcgacggccgacagtttcttggccgcgaccgggccgatgtagtcgccgattcttccgtaatcgctcataatccatgagcatagaccaatcggacagggaacgcctcgggcgaatcagtcggacaggtagggtttcatcgcctcgcctatggctcggatgaccggcactgcgaccgagttgccgaactgccggtatgcctgcgtgtcggataccgggatactgaacgaatccgggtagcccatcagtcgcgcgcattcgcgcggggttagccttcgagggttctttccctcgccgcgtgagaccagtatctcgctgccgtcctttccgtaccgcgcgctcaacgtgcgcgtgtggtcggtggcggcatcgaccatgccatatccgaaaccgttgcctgcggcctcgtgcttcttcttgtagttctggaggtacgtccacagcttgtcgctcagaacatacttgtcgggaacctgggaggcgggcaggaggatgctgccgacgttgccgtgcgcgatgggcttcacatcatcgaacgtgaacccgttctcctcgcggaagcccacgatgtacgtgcgttccctgtgctgggggacgaagcccgccgcgtcgatcagcttgtaggtgacgtggtatccaaggtcttcggtcagcacggaatatatcgtcttgaacgtgcgcccacggtcgtgcgagagcaggttcttcacgttctccaggaggaacgccttcggctgctttgccttgatgattctcgccacgtcgaagaacagtgtgccttgggtcttgtcctcgaagccggtgggacggcccatgctctgtttcttggagacgccggcgatggagaacggctggcacgggaatcccgcgagcagcaggtcgatgtcgggaacgtcatgctcgtcgaccttggtgatgtcgccggccacgggattctcgtcgtgccagttcgcctcataggtctgcacgctgtacttgttccactcggacgaatacaccacgtgcgcggcatcgcccagcgcctgcaccattcccatgcggatgccgccgatgccggcgaacaaatccgctatcctgatctcactcatacggttcctccgattcccgagaaacccaggatagcacatgagaagggcgcggcccgacaccccgcgaaatcatcgcgtaaataatcccgtggcgttcgggagcaaacttcccccggacgccacgaccgtcacctcagtaagccggaacctccatcgaggccgtcgaggggaacgccgggcacggtgcccatcccgttcacggcatcattcgtcttttccacgaccccagacgattgggccaaagtcagcccgccgggcacatggccgacggcgttctgtgagagccaatcggagagccgggagtagtcgcccgtctcgtagtagcgcaggagcatagagacgaactgcgccttgtcttcgggagggatcgagaagacgccgatgccgtcgtgtatgagctggtggttggcaaccatcagcgcggtgcgcttgttgccgtccgaaaaccattgtccccgcgtgaccgcgccgaacagcagcatcgcagtggcctccccttctgactcctccaggatgccgcgaaccctttcctgtgaggactcgacggcggggatctccggcacccatcccgtgccgccgatcctcacgccgtattcacgcaagcggccggcgtcgcgcacgcggccttcgccgatgatgcggttgtattcgcggatgtactgccaatcgactggatagtcgatgttcccgagcaggaacctccacgcgcgcttgatgttattcaccgtgactatatcgtccacgctcataccctcgggcgcgcgcccgtcgaagatctcctgcgtgtcggggaaggtgacgccatcaacctcgatcttggcggtgcgccagatcaaatcgaccagcagccgcttcgccagttccacggccgtgcgcctatccgtcgtcgtatcgttcctcaccggttccatcaaagccccttatccgtttccgataattctatcgaagtggccgtgccggcaaaggacgcatatctctcatagacgccatgcgccgccgtgccgggcgcgcgggcggagaatcatcgtatgataccgaatatcgtcaggggctcggacccggccggcctggtgcgctacctgttcggcaagggacggcgcaatgaacacaccgaccagcatctcgtgtgcgcgagcggcgacatgtttccctcgtttgacatggatggcaagccggcggcgtcgtatgcggagataggccgcaggttcgaccgacgctaccgcgtcagggaacgcaaggacgatccgttcccgcccgacatgcgaggcaagaacaaccccgaacgagagcatggcaggaagcgcgtgtggcactgctcgctcgccatcaaggccgggcagggaatcctgaccgaccaggaatgggaggccgtcatccgcgattatctgacgcgcatgaacatcatcgacggcgacgacgatcagggcgtcacatggctcgcggtccgccacggactgtccgccaacggcaacgaccacgtgcacatcatggtgcagctcgccgccgacgacgggtggatcaacccgtaccacgaccggatcaacgcgcagaaatcatgcaggcggatggagaaatcgcgccccgaactggtcgagctcgcacgctccgacaccggcacgcgcgtcagctggcagtacgggcaatggcgtcaatgggccgaatggaaggcgcgaaacgagtacggcgacgacgagggatgggatgcgttggacggcaacgagagaagccggctcgtcacggcggtcgccgcctcaacgatgccacgccaatacatcgcccgaatcgtggaggcgtgcgccaaggcatcgcgcagcgaggacgagttcatacgccgcatacgcagggaaggcttctccatcgaccccaggctgcgcaagggaaccgccaaagactcgttcaccgaccccggccaggtggtcggctacaggatcacgtggcgcagcacggacgggtggacggaacggttcaacgccttcgagctcggcgacgacatgcgattgaaacgactgcgcgacgactgggcggacgatgccagaagccgcagcctcgccgtccaggaatggcgcgccgcgatggagaaccgcccgcccttcctcgatgacggacgagaaagacaccccgagaatctgtccacgcacgacatggaacgcctcgtatccgaagcgttctgcatcgccgccagcctcaacaacgcggcggacggcgacgaataccgggcagcgatgcgcgagggcctgcacacgttcgacatgctgcgcgaacgctacggaatcgcgccggaatacggtctatggagcatggtcgcctctgacgaggagaaccggccccgccgttaggacgcttcccggaaaaaactcagatggtacggcccgaggagggaaaaccgagcgaatcgggcaaagccgatgctggatcgagagagttcgccggctcgtctcccggcatgatcggctcgatggactcgttcgccttcgtccagcacgcgttcaggcgatcggccatccgcgcgtccaggccctcgcaggattcggatatgccggcgaggaccttccccgccatacgccgggccatatccgccaccctcgaaccatcgagaccgtgacgtgtcgccagatcctcccaatcctggggcgtggtgtgctccgcgaaggcgtgatcctcgttcaacggcatggtgagttcccaattgaactcgggccaatacctggtggcgaccgcatcatactggggagacaggcgtatccccgatgcgggatcgaggatcagggaatagttcttcgcgtgcgcgtcgctgttggcggacgacgtgttgaaggccagcctttcgagccaccggtaggacagggaacccgacgcatcgatgcgttgcaggagatccaggcagtcatcggccgacggatcgtatttgtcgcgggtcggcaatcccaacgcttgcaggaagtcctcttgccgcagtcggacgattcggccttcctccaggcgacggtcgaaccgttccacgatataggccgtcttgcgctgcgccgtgatctcgccgcgcgcgggtgtgtcgatgccgcacagttccgacaatcgcatcgtcgccagttccaccttggtcgcctcgggaaggtcatggggcttcggtttgacgatgtgggtggagggcagcatcatatccggccaataccacttgccgtccacgcgggacagtgtgaacttgccctgcgcccctcccaaggagaaccggcagtggctgtcctcgtcccaccagtagttcctggtccgctcgatgcggtcgatttcgttggctatctgggaatcggagatcagacgaagcgtcggcgatgggattggaggttccggggagagggagaacaccagtccgccggtggcgtcaacccggtccagcagatcgaagacgccggccgaggaggcattcaggtgctcacgcatggcctggcggacgttcggattgtcgggcaatagattgtccaggaaattacgcggtgcctggtctctccatccgccggttctgggcaggctcagactgatcggcagaccctcgttcgcatcatacgcgaacgatatgcgctcctcgtcgtcttccgagaacacgcccacatgatgcccgttctcccaggcgtgcagttccctcacagcagtctccccgcgtaggcggacggcagcgtttcggtgcggatgtgcagcaggtcgaacatcctgtacacgtagcggatggaggtcagaccggtctccacgagctcttcggcgcttgagaggggaaccccggctctcctggcgagttcggcggcgtcgagacccatgacggacatgcgttcgcgcacgcaacggcggaccgacgaggtgtcggggaagaaccgcgccgggttctcctccttctcgtcgggaagacccttgtaggcggtcagggcatcatatttcgacagatccaacgtcacgtgtgccatgctcgtcctttccggttccgaaagccgttgacaccatgatacggccatccgatgccggcgcaccccacgaacctcatggcaaggggggcgccggcatcggcgtcagcgtgcgttgccgttggtctcgggttgcaggatctgcggcgtcgagacgttggcctggtcgggtatcggctggtccgtggggttcatggaggattccatggcgggactgtattcgccgaacgggtcgggcccgttccattcctcgggttcgttcaggtcgagtggcatctcctcgtatccgtcgggctccccggtcgtcaggtcgccgcctcccgtggtctcgggctcgggtccggatgccggtttgcgttcatcggcggcgggcttcgtatgctcccgcacgggtgtgggggtttcgacgattggcgcggcgtcagcgttctcggtgcgttcgacctcgcttatggtgctgggctcgtctcctgtggccttgttgtccgcgtgcgaggattccggcaggccctggtccttgaggaagctgattcgggaggcggcgtcgtccacgccgttgaccggcgcgcacatcacggcgtcaacgatcctgtcgtggtcgtagcccgtccattggccggtgagccgcgagtccacgaagaacgtggcgtcgtcgccgtgcgcggcctggaacgcctgcgcgtcctccacccgttgcaggtccacgggcacgccggccgtgttgaaggcgttcagggtggcctgcaacgcgggcgactggtcggtgtaggtgatgttcacgtggttggtcaattggtcggctgcggcgtcgatgtgcgtttccgggtggcgtttcgaccattcgtccttcagccgggccttcgcctcgatgatctgcctgcggtagccggggtcgttgccctccagttggtcggcgaccatccatccttgcaagagggacgagtcgcgcatcttcctccagccgtcgccgtcggcaagcacggtcgcgttcagggtggactcgaaccccttgttgaggcgttccctgttgtccatctcccattgttcgaggcggatggattgctgctgccgtctggtctgctcgtagcgttcgttctggacggcgcgttcggcgcgttccctgcgtcgcgcgcggtcgccgctcagctcgttgtgcagggtgcgcagctgctgggcgacgctgttccagctctggaccatgatctggtcgaagccgtcctcgggatcagtttgagccattgtttctcctccttgttggcgtgatggtggtttccttgttttccttgccgcctgcggcggggaccgacaacgtttccaggatcggttcgcgccatgcccggttcgggcgttcgcagggcagcggttcgcccttcctggtgagattctgcttgcagtcgaggctggcgacgatgccacggtccttgtcgaaaacgcggtcgagcatcgacgccgcctggatgtagaagatcatcatctggccgggtgccttgcgcgcgttctcgtaggcgcgccacatggcgtcgagcgggaacacgagcgccggatagcgccaccagtcgctcacccattgcatgttcacgctcgcgctctggtggtagcagaacacgttggccacgaacctttccacgaacgcggcgaggttcggatagtaggtctcgctgcgccgcattcgcgcgccgaactggccggacacgtcccttgcccgcgcgggatcgaggtcgccggattcgtctcggccgagatccgtcttcccctccggcgcgggcagtatacgggtgtcggattcctccgcaccggcctttggaggggtgtcgtcacggtccgttgcgtcttccggcgggttctcgtagccgttgccggtttccccggcatcggccggaatcccggatcggatgggttccgccgcgtgccggcctgccggcacctcgggtgcggtcggcgtcggctcgccttggcccggcatggtttcctcttcgatctccttgtcctcggggatgtgcggcgcttcggggttgggcagtcccttgccgtaaggcacgcccttctcctccaggatggcgcgggtgaacagttccagccatccgcagtccgatgacagcagggtcctggcggcaccgaccgcgcgctcccattcctccccatcagggccggacgtggtgttcgaggtgtgttcgctcattatgcggcctttctctgctcttctcgggctttcgccttggcctgcgccagggcgtcggcccattgcctgttgcccgtccatggcagggtcttgacgatctgcgcccgggattgggatgcgagcagcagcgcgcggccgacgggccattcggtcaggtcggaaacgtcgaggatgttctccttctggatcgagttgttcacgctgcgccggccggtgccgtcgatgttgacgctgcctcgcacgatctccctctggcccaccagctggctgatctcgccgaggaacttcgcgtccttgatgccgccaaggtagacggtgatgttcgcgttgttgaacagcgagccgaagttcgtctcgccgaacgcggccctgccctggtcggggttctgccagatcgtcatgatcgggatgcccgccgaaccgaaatacgagtacacgtccgccagttcgggccagcggcagatgttcgcggcctcgtccagcacgcagcacaacgggaccggcagacggcggttgttgccggtgaactcggattgggcgcgttggaacgcggtgaacgccaccaccgccgtcaggctcgcggtcaacgcggtcgagggccggccctgtgcggaaagcaggtacagggtgtcctcgctcgtggcgaactcgtagggatcgaacagaccacgccgctcgtcgatgttcccattcgtatcccggtgcgggtcgatccagtcgatgatctcggggtccgcgaggaacgcgaccatggtctgaaggctgccgaacacgccgcttcgggtttccggcgtcagcgcgatcacgctggacacacgcgaggcgatgcccgcgtagcgcgggtattcgctcaggatgtcggccggcgacgtgtcgcgctcgttggagcaccacctgaacacgtcggacacggaacggcctcccagatgcgcggcgaacaggtagtcggcgagctgctgggcggcggtgccggggaagaagtcgtcgccgccggtctgcggctggcccgaggcgtaacgccagcagtcggcgatgcgtttcgcgtcggcgatggactgcaccgaggcgatcaggtcccacacccacggcgcgctcttccggttcgggtccgcgatgcgttcggggtcgaacgtccatatttcgccgttcggatggtcgagcctgcggatcggggcggtcacgtcgaggatgtcgcccttgttcgaggtcgccaggcacgggcccggtgccgagagcacggccgggatcgcgtagcacagggacttgccggaacgcgggcccgccagaacgatcgccatgtcctcccaactggtgtacatcgacgtgttgtccacgatgttgagccccagcggatagcccggcgacatgccctttcgccagtggtccgcttctatgagccttgacgccatggcctcggcgcgctggcgcgtcaccttctccacggcctcgccatggcccatcgccggcgcgtacacgtccacgcgggtgcgtgccttggcaccggttgcccacggcacggccttgctggcgatcagccacgcgcccacgccgcacaccacggccagtacgacgagcacggccacggccagcgcccactggcctgcggtcagcgaccattggccggagaccaggtacatgagcgcgaagatctggaagggatgccccgcatgggagcacacgagggcgaacaccgtgaggatcagggacaccgcgacgatgatcgccagttcgatcttgcggctgggacggaccgtgccgcccagatccttcactcggttcgattgcagtttcggatcgacgtcggccaagattcatttctcctttcaagcatgacggcggaaccgatggaagcggtcccgccgtcgatgcgccagggcttgcgtcatggctagcgggcgttgcccgtcgtgaaatcggatggggtggaaaggaaatccggtgccgcagggtccgccggagcgggggccgcgcccggcgtcggatagcccgacagcggttcgaagggctcgccgttgaaagtgcggggaacgccgtcgccaacgtattcgccgcgcgaggcgtcaacctggtccgtccatggatccgttcgcccggcatcggccacggcaccggcctgttccttgtcctggcgtttgcgttcgcgggcgagctggatgcgctgggacacgatggaatcgatctgcatggaatcgccgatcacgaccggacgcgcgtatgccttgccgtccttctggctgatgaaggcgtcgggatcgcccatgcggccggtcgccaccacggcgtcgccctggcggaaatccatgccgtgcaggagctcggcagcctggccccagaatttcacggtggttctcaccgggccgagcggattgtccgtatagctgccgtccttctgacggactcgcgggcggtcctcatacacggtggcgcgcaggtacgccgagctcgtggtgccgtccgcgttggttttcgccggccagtaatcggggttcgcggcgaggagaccgcgaaccacttgcattgactgtggcatgatgatggtcctttcattcggaaaataccagcgccttcaatggcggcggcgactcccatcatccggccggaccggtggcatcgcggggcacggcgtctacgtcagcgccccaaatgcccgccgttctcccacacgttcgccgcctccatggcgggatcggtttccggcagacggtcgagcacgcttgacgcgaaccggtccgaggcgtcgtagccgatggcctgttcggcgagttcccgcgccttctcaccgtcgcccatggcgaggctgagcatggccttcaggccgatgatccggtagcaggcgtccgtcggcgcgttggcctccaacgggccgaggatccccatcgccatgtcgatgcgcgccggatcgggcgtggtgccgttgtcgatcagccgggaaaacagcaggtcggtgttcaccatgccgtccggcgtattgatgcgttcgcgcaatgccggaagggataggggagcgttctcggccagtatgtcgctggcgatcatcatgcacgttgattcgggcgcgaactgcatcatcacgcccaatacggcgagccggttcgcgtcggacgaccattcgcccgtggagcgctgttcggccatgagcttcgaccagtcgtaggctgccgcgttgcgccagatggtgcgcacatgttccgagaatccgtcgtaggtcatgcctgagtccagatattcgtgcgtggctgcggtgatcagctcgtccaacggcggttcgtccgtatcggcggctgcggcctcgctctccacgatgaacgggatgcggggctcttcggaggccaggccgtccgtttcttccggctgctccccgttgatgcggtccgcttccatgcggtccacttcgccggcgaaccattcggagcccgcgaaataggtgccgtccatcgaggagagcaccggctggagaatggatgccagttcgtcgtacacggcatcggggttccgcaacgcctcgatggtttcagtcgccgcgttgtattcgatgatgcggttcgccagccgcacggcaccgtcatcgggtcgcacgtcgtcatacgattcgccccaatgctcgatccatccgatcatcgtctcccgtgtgatccgctcttcggcaccggtgttctccaaaggcatgttcggctccttgacaatcctcggcggcaacccggcgttcccgccatgaccccgatcatcagtccaaggccatggcggggtggggcatggcgtctacagggtccttacaggtttcgtcccgtgcggccggtcaggtcgtccacaaggccgaggagttccggttcgggccagatggagttggcgaaaaggtagtcgtccgtcagggaccggtccttgaatatggttcgcgcgtcctcccggatcgaggccagcgagccgtcggcgatcatgccggtgaggtcctgtgtgcagtacaggtcgtatggcgtgaaccctttgccgttccaatcggtgtgatgggtgatcgaatactcgtattcgttccagtgctccatccatggaagggcgtggtcgccttcacgggtgacgaccgagtagcggaaccagccctcgggaacctgtatggcatcgccgtcatacgggtccgtcagggaatcgaggtagccggcgacgatggattcgccggcatggaattccgtgtaccatgcgaggtcgggattgcgcagcgcggcgtgcagcgagtcgagcagtgcggcgtcgttcatcgtggtcctttcaccggttttccgtttccggcaggatgccggtgttgtcgtatattctgaacgtttcgacggcgtgcgcgacccgcgccctcgattcgccataggtggcggaatcgaccgtctcacgccatacgggttcacgggtttccgcattgccgtacggcttgggctcggtgggggttatcgacatttcgaagtcccatgaggatgcgccgtgctcggcggggcggaagtcgagagtgctgcggttgcccgtcagccgcagcagccgggattgctcgccgagccggtcggagagggatgcggagcgtgccacggtgcggatcatgcgtttcatgccggtggcgaggtggtctgtcatcgcagggttcccttctaggcgtgccatttgaggttcgtatcgttgaacccgcttttttcgagcgggcacatctccacgttgatggggattccgggcagtcctcccagtttgatcaggaaacggcccagacccttgtgcgaggcgtcggagccgaagttgacgggcgtggcccaatcctccagcatgtcctcctcgcgccgggatacgggcagtccgcattcgccgcgcaggtagcggtccacctcgatgcggctcaaagcgcccagcaccttgatctcgctgcgttccacgaagccgcgcgccttggtgttctgcgccggggtctccatgcacatcaggtccttgaacgtgtgtgtgatcatgatctggcctacgccccactgcctgttcagacgggtgagcaggtcgagcttttcgaccatgagggggctggcgcgcaaagcgcggtgcatctcgtccatgatgatcacgtggttgcgccggggctgcaatccctcctcggcgagcatgtcggcggcgttcttcgcggcgaacgcgctcgtccatgtggtcgccagcacggcggcgaccacatcgtcgcccgactgggccagggcgctgatgtcgaagtccacgggcctggacaggtcgatgcgcgcggtggtctggtcgccgaacagacggccgaacttcgtcatgcggttcgagaatccgtgcaggtcggccagaaggccgcgaacctgcgccctgtagagctcgtcgttttccgggtcgtcccagaccgccgccatacgcacctcgtcgggcccttcgcgcagcaggtctcgcaggtccgcgatgacgggaggctgcgggtcgtcgccgtgccggtcgtggagcacgcgcacggccacggaaaggatatcggattcgcgtgcggtcacgcccctggcaccgcccacgtcgtcggcctcgcggccggtgcgcatgatcgtcaaaagcacctccatgagcgccgccctcgtgtcgttgtagtagtccgtcaggtccttgcgcgccttgccctccaagcgttgcagcgcataatggaggtcgccggggtccaggggattgaccacgccgatgcccgctcccagccggatgacctggccgccgagcatgagagtacgagatcggggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgttgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaacaccgtgcgcccggccctgcaggtcatcaagaccaagcccggccagaagctggtctccggcgcatttctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccggatctgccggtggtcggttccatccagttcgacgccgcctggtcccccaccgtggccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggtctcaacaagccggtaaacgacctgtcccgtggtgctctggtgcaggacatcatcaacaccatcgccctcaccgccatcgaagcgcagtgagcccggcttggctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccaacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagtaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctacatcggcaactacacctaccagatgggtggctgcgacgtgatcaccttcaccgctggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgatcccgacgaacgaagagctggccatcgcccgcaagtccgccgcaatcgccgaagccggcaccgacacctacggcaacaccttcgccaagtaagtaaccgccgttaggcatctcaccaatctctagttgcaacactatgggggctgattccgattggaatcagcccccattcgtatatggtcatgagacccctacccctgcgtcatactccccctcagtcgcctccggcggactgaggggggtccaccagaacacaggaccccttactgcctcagcatgccgctccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccgacaccggttcgatacgcaatccatcaggcaattcctcagccgctcccccaacacgacgaatctcgttgaccaatgcctccagacgattcgtttcgtggccgcgcaggtgaccaataccaaccatgtctgtcgatttatcagcaaacaccagaatcgccgccaacgagggcgcaatctccccggccgccgtcaaatcgaacgtacccagcccacgcacggtgccgtcaccggtcacctcgcaatagcgcacgtcgccgatggtcgggaacgatacttcggcacccatctgctccagatatccgggcaacaggccgcccggctgggtggtggtttcaggccaatgaggcacccggaccgtgccgccggcgatcaatgccgcgccgaggaatggcgccgcgttcgacagatcgggctcaacggtcaccttgctcgacagttgcattgcgcgcggttcaaccgtccatgtgcgggcggattcgtcggcctcaaccgcaccgccggcaccggtcacatcggccacggtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcggacgtgcataagcctgttcgtcgccatcaaaattcactgggccatctgcaaacagggcaaggccgggcacgaaacgcatcaccgtgccggccagtccgcagaacacattgacgttgccatggaatcggccggatacaggaggagtaaccgttacggtggtgtcggttgcggaatccacgtcgcagcggacaccgagggcttcgagtgcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgcggcgagcggggcaggccagagattcgtgagtcgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgtggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatatcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaacgattatgtacgggcttcttagcctttgcgactatcgttaccgccttgccgagtaccgttgttcatgcagaaagaaagcagtattggacacaatcgaatgagcgtgtcagtatcgttgaaaaagtaatgaatgacggttctatcggttcaacctttaagggacgaaccagccgcggtaccatggcgctgatgcatgactatgccgagctcatcaatgaattacgtccgacagcagagcaattcaccgagatcgagcaatactgggtcaaacgaattcaggcgttcttcaccagcaaaccattcaagctgaagtccgacaactcgctttccgttgatgcggccgtggaacatctgctgcggcaggcagcgcagcggcgaagggagaatccgggcaccatgtacgtcggcaccgtcctgcagcatctcgtcgcggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcgtcggattgacgcacggtgtgcagaacgtcagaggtcacgccgctggcgggcgaccgcaggttggcttccggctgccggccatcctgcggctgcgcggcaagccagcctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcagacggatgtcgtcatcccagatttcctccggccattggtcgggactatagtcgccaccgaaagcgatgccgcgtccgtccgcggtcagcagttttggccatacgaagtcacgtcatgcacgcacggttatctcctttggcaggcggcgcagggccacggcccatatcggataccagctgatactagctgatagacactcctggccgatagtcgacacgccgccggttccggccccactgccggaaccgacatgggtatgttcatgaccgccgaccgcaggaacgaacaagcccttccgccacggaccgcatcttgcggttcaggcggacgggccttatgggagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgagaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcctgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgataatcatggagaccatgccgccggtgaacaggtagcgacggggaatccagcggttgagaatcgggtacagcggcgccatgatgaatccggcgatcagcgggatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgacgaacagcacgatgaacagcgtggtgttcacgttgaccagtccgaacatgccggagaagatgagcatgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggcgagagccttgctgtagctgacgaacaggcagctggtgacgtacgtgacgaagtacgtgctcatcgcgttgtagaaggcagcctgccccaagttgccgcacgcgtaagcgatgcgctggccgagcccgcccttcctgcggacgtcaccgtccgcgacattttcgttgctcattaatcttctccttaagaacccagagcatggaatcactcattgattttgtaaagtatagcatacaagttttatcaccgtaagcatacaagttttatcaccgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttattcttttcggtaaaggaggccccgacctcctccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggaaaacaatcacgtcgcgctctaccgcaggaagttcaccgtctccgcccccgtggcaaacgccaagcaggccggcggatcggtgtcgatcatgttccacggcatggccacggcgatctacgtgtgggtcaacggcgcgttcgtcggctatggcgaggacggcttcacgcccaatgagttcgacatcaccgggctgctgcacgacggggagaacgtcgtggccgtcgcctgctacgaatactccagcgcctcctggcttgaggatcaggacttctggcgtctgcacggcctgttccgctccgtcgaactcgccgtccgcccgcatgtgcacatcgagaacacgcagatcgaagccgattgggatcccgaggccggcaccgcctccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcgggccgctgcagggcatcgaaccctggagcgccgaaagcccgacgctgtacgagcttgacgtcgacgtcatcgaccaggcgggagacgtcatcgaatgcacgtcccagaaggtcggtttccgccgcttccgcatcgaggacggcatcctgaccatcaacggcaagcgcatcgtgttcaagggcgccgaccgccacgagttcgacgccgaacgcggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgagaccaacctcgaagcccacggcagctggtccctgcccggagacgtcctcaccgaggacaccatcgtgccgggcagcaagcgcgaatgggaaggcgcctgcatcgaccgcgtcaacagcatgatgcgccgtgactacaaccacccgagcgtgctgatctggtcgctgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgcatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagactttggcgaccgtccgtccgactacgagttctccggcgacggcctgctgttcgccgaccgcaagccttcccccaaggcccaggaagtcaagcagctgtactcgaacgtccacatcgacgtgacgaaggattcggtgtccgtcaagaacgacaacctgttcaccgccaccggcgactacgtgttcgttctgagcgttctcgccgacggcaagccggtctggcagtccacccggcgtttcgacgtgccggccggtgagacccacacgttcgatgtcgcatggccggtggcggcgtaccgcgccgacgcccgcgaactggtgctgcaggtttcgcagcgtctcgccaaggcaaccgattgggccgaaagcggctacgagctcgccttcggacaggccgtggtgcccgcggacgcgatcgcgacgcccgacacgaagccggccgatggaaccatcaccgtgggccgttggaacgccggcgtgcgaggcgccggacgcgaggtcctgctgtcgcgcacccagggcggcatggtctcctacaccttcgccggcaacgagttcgtgctgcgccgtcccgcaatcaccaccttccgtccgctgaccgacaacgatcgcggcgccggtcatggcttcgagcgcgtccagtggctgggcgccggacgctacgcccgttgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtggcctgcccaccatcccggcgttcggcatcgaatggacgctgcctgtgcagtacacgaacctgaggttcttcggcaccggcccggaggagacgtacctggaccgcaaacacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccgttcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccgatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcactcataagctatcaagagaatccagaactttttttgaattcatatgctcgacacgcaatgtatccagcgtcgtttataatgattcattgtgccttaatggcgcatcgggctatagcgcagtttggtagcgcgcctgctttgggagcaggatgtcgccggttcaaatccggctagcccgacaaacaaaaaagcctggaatctcaacgattctgggcttcttcttttatccgaccgctaaacgatttatccggttttatccgatgaccgtagaacctatatggccttgcggtctaagggacttttgtgatgttgggaccccacctgctagtcagttcgattccatgcgacatcgatttccgcttcccaatctcaaatgacaccaaaatacctgcaaccgattgtgcaatcccgtgggcgggagtgggttgcaggtaaaaggtgtcgagttacagcccagaatcacccctaactagtaccgaaatacccgcaaccgcagtaactaacccctttatacctgcaatccggcaaatatggttcagacaatccgcacatccagaccgctatccgaacacaccgtttatactggatcacacatcgaatcaacatctagaaccgaccgtctccaacgacccatagggagagcacatggacgatataagaccacgctgcggctggtgcaatctcagcaatcccgtctatgttgcctatcacgatgccgaatgggcggttccgtcgcatgatgaccaccacctctttgagatgctggtgctcgagaccttccaagccggactgtcatgggagacgatactgaacaaacgcaagcgtttccgtcaggcgttcgatgggttcgacatcgaacggatccggcgctatgacgagaacaagatcgccgaactcatgaacgatccgggcatcatccgcaaccgtcgcaaaatcgtcgcgacggtcggtaatgccaacgcattccgggatatccagacgtcgtacggcagtttcgacgactatatttggcggttcaccggccgtcacgtcatctacgagacaggcatgactacatcccctctgtccgacgccatcgcagtggatctcaagacgtacggcatgcgattcatcggcaccaccatcgtctacgcctatctgcaatccatcggcgtcatcaatgcacatgagcctggatgcttcctgcacagggaaaggtgacccgcgcaaggatttataaggtcgctcgggcagaatctctccgagaggaacccgtgcttctagttattttgcttatcgagttcttggtagcgctctttgaccccggtaaggattccggcagattgttcacgctactgcgcggtgagcgcttcgagcagttcgccgaaagtcaacccaccttcactaccggatgacggatgatggttttgagattttccggtttggctcggcgcgggtcggataggtagatctcgtgatggcggcgggcgtcggagaagtcgagcccgtagccttgcgaacgcgcgtagccgtccagaatcgtcacggttgcgggctcgtcgtcgtacgggcctttgtgcatgacctgcgcgaccacgccttcatcgaagtcgaagagatatgcacgattgatgtcgacttcgggatgcttggaggcaaacgatgccttggcccacgcaaagacctcatcggtcacgaattccggcagacgaatcatcgaagtccaatagaagtcggttttacgcgtgtaatcgacgccgggcacacccttctccatgctccataagccctccagcggaggcacggtgtagtcgaagtacccgtcaatgtgctcgtccggattatttgacttcttgttcattttgatggtgaacgaaatgccgtacagcagttgcatcgccttggcgtagtcgccgccttcttcgttcggatctcctacaccgtccaccgcgacgaaccgcatcgccggcaccgtgacgatggcgggcatcctcttcggctgatacaggtccttatattcctttttatagtcgaatgccatcgctcatttcccctccgccaccgcatcgatctcatcctggcgccgccaccgcttgaggtttggcaacagcgccgacatgcagtcctcggcctgttcgacgctgatatggcaggattccgccatcggcacctcaaaacgggtgctgatcagccgaatcatgtcgatgctcggctcgtggaggagcgtaaggggcgcgagtaggggttcgcggctttgctgcggtctctccctcacccggctacaccgggagctccctcgtcagagggagcttaaattcggtctggttataggcccatgggcttcttgggctttttggcgctcatgagcatgaggaagctgcgggactgggcggtgatcatgaagcccgcctcatagctcagcgccggctcattcgggttgtgcgtatccacgaccagctgccatttgcggccgtatcgctcatccggcagggtgaacataatcggctcgtaatgcgcgttgaagatcaggatgaagtcattgtcgaccatccggttgccgtaccagtcgacctccgggatatccgaaccgttcagatagatcatcatggagaacgcatgcgtgttctgccagtcgtccatatccatgatcgagccggtgtggtcgaaccattcgacctgcggaatcgtgttcgaatcgtcgccgggctcacggccggtgaagaagcgacggcggtgcaacaccggatgatccaaacgcagatgaatgagtttggaaacgaaggcgagcagttccttgcgtcctttgtcaagatgccagttggtccaggagatctcgttgtcctgacagtaggcgttgttgttgccctgctgggtgcgggccacttcgtcgccaccgcaaatcatcgggataccctggctgaacagcaacgtggcgaacatgttgcgcatctgacgctgacgcaagtcgttgacgtccggaatattggtcgggccttcaacgccgcaattccaagagcgattgttgctctcgccgtcgcgattgccctcgccattggcttcgttgtgcttttcgttgtagctgaccaggtcgttcattgtgaaaccatcatgcgcggtgatgaagttcacggacgccaccggtcggcggccgttgacctgatacaggtcggagctgcccatcaagcgcgaggcgaattcgggcaacgtggagggctgcgagcgccagaagtcgcgcacggtgtcgcggtagcggccattccattcggaccagctggacgggaagccgcccacctgatagccgccggagcccagatcccacggttcggcgatgagcttgacgcgcgagatgatcgggtcctgctccacgatgtcgaagaacgcggacagcttgtcgacctcctggaactggcgtgccagcgtggcggccagatcgaagcggaagccgtcgacgtgcatttcagtaacccagtagcgcagcgaatcggtaatcaactgcagcgcgtgcggcgagcgcatgagcagcgagttgccagtgccggtggtgtcgaagtagtgctgctggtcgccttccaccagtcggtagtaggaggcgttgtcgatgcccttgaagctcagggtggggcccatatggttgccttcggcggtgtggttgtacaccacgtcgaggatgacttccatgccggcgcgatggtaggccttgaccatggacttgaattcgttgacctgctcgccgcgttccccggaggaggagtaggcgttgtgcggcgcgaagaagccgatggtgttgtagccccagtagttcgacaggcccttctcctgcaggaaggagtcgttgacgaactggtggatcggcatgagttcgatggcggtgatgccgagcttcttcaggtattcgatgacgctcggataggccaggccggcgtaggtgccgcggatgtccggcggcacgtccatgttgaggttggtcatgccgcgcacgtgcgcctcgtagatcaccgaatcgtggtacgagatgtacggatgctggtcgttgccccaatcgaagtaggggttgatgacggccgacttcatggtgtgggcggccgagtcaaggtcgttcatcgccgagttgtcgtccgggctcttgaaccagtatgagaacaggctttcgtcgccgtcgatattaccttcaatggccttggcatacgggtcaagcagcagtttgttggggttgcatctgaggccgtgcaccgggtcatagggaccgtagacgcggtagccgtaacgctggccaggatggaggccgggaatgtagttatgccatacgtacgagttccgttcggtcatttcgatgcgtgtttccacatcgtgctcgtcgaacaggcatagttcgactttctgcgcaacctgtgagtacagcgcgaagttcacaccggcgccgtcatagctggcgcccagcggatacattgatccaggtctgatctgcatagttttcagtatcccactttttttgtgtcagtgatgtgccggggagttgaacgtcaggagaacagcgacggcttatctttgtcggagttcctggcgatgagtctgcgtaacgcctcatgctggatggcgatcatcgaattggatgaggtgatgcgcgtggcggcaaggtcgctccacggaatccacgcggattccacatgctcgtccgcatcgaaatggcgctgctcccgcctgaacgggcccaaatgcaacaccatgatgtgggccagttcgtcggtcatgccttcggacgagtagaaatcacctacgaagtcaacgcccatggtgtcacggtccggcaccacgccggtttcctcggccagttccctcagggccgcgtccatgatgtcctcgccctcgtccatcagtccggcgggaagcccgtaggcgaacatgtccgatccggcgcggtattcgcgttcgatgaggtagcggtcggtggacatgtcgtgcacgagcatgaccacacagggggcgtgacgcagcacctggcggccgatctcgtgttccttgccctgcttgtcggtcagagcgatgcgcatgtcgtccacatggaagatacgcccggtataaacggtttcgctactgatcactttggcgggcacgtccatgtcgatgccgtccgaggaggcgttcagcttatggtcgagccgatgctccagttgttcctgcttgcttccgccaaacatgtcatctcctcggaaaaaacgtttttgccacgttactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtagttgaaccacatggattcgatggcggcatgaggggtgttgatgaagcagggacgcacatggctctcccccgccattccatggccgagcatgatgccttgggacctcatacgggcttcataccgggcttgttcgatggcgtcggtcaccgggtggtgacgcaaatcgctggttacgtacacgtccgcaccggtggcacgtacctcgttgaacagggagtccccggagccaggcagaatggccacatactgaacaaaagtgtccgaatcgccgcatacctggatgccgagcgcgctggtcatgccatgatcggacacttcgtcgaatactcgctgagcgaaatccttcagggcaacaggcttcggcaaacgacccacacgccccaagccgaccggatgagaggcgtttgcatcgtcaatcggcacgagtggtttctggtcgatgagtccgaagtagtcggccgccgcctgtcccacgccgcgatacgcagcgtcggcattagtgtgccctacccacagcccgcagccgtgctggtagagtctgcggacgatgtcgccccggaaaccgagtccgctcgtctcgtgtacggaacggaagaacaacgggtgatgggtgatgagcaggtccgcgccagtagcgatggccttgtcaatgatggcggaggtcgggtcggcggcgaacacgatgcggtgcacgtcgtgactcagatcgccgacaatgaggcccggctcatcccattcctcggcgtagcgcaatgggtacagggtctcgagaacgtcgatgacttgcttgagattcggcatatgtcccattgtagtgggctattgctgcaagggactcattctgcaattgcggacaagccatgctcgtgctcttcattgctcgactatcggctcgccttcgcctacaaacaatccactggactgtttgctcaacggctcagccccctcacccgaggggagctagaaattgtcagtgtgcagcgagttgccagtcggaaccgatgccgcacgatacgtccagcggcacggcaaggtcgacggcgtgttccatggcgttgcgcaccagttcggtgacctggtcgccttctcccggcgcgatttccactaccagttcatcgtgaatctgcagaatgatacggctcttgacgtgagcctcggccaaggtctgctcggcgcgaatcatcgcaatcttcatgatgtcggcggcggatccctgaatcggtgcgttgagtgccgcacgttcggcggcctcacgcgcaacacgattggtcgaatgcagggccgggaagtagcgacgtcgtccgaaaatggtttccgtataccccttctctcgggcattggccaccagcgattcaaggtaatcgtgcaccttgccgaaggtatcgaaataccggtttttcaacgcttccgcttcacgtggcgcgatcttgagttgctgggcaagaccatacgtgctcaggccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcatcggacagatcagccataatgcgcagctcgacctgtgagtaatcgcagctcatcagggcctcgtacccctcccccggcacgaacacgccacgaatctcacggccggcggcgttccgattggggatgttctgcaggttcggatccacggagctcaatcggccggtggcggcaacggtttgctcgaaagtggtgtggatgcgctcatctgatgtgttggtggcatcgatcagcgtttggacgatctgcttgagcttgttgatctcgcgatggcgcagcaacgctccgaggaaaccgttggcccgctcattgtccactgatttgacatacagatcctgcaatgcggccgcattcgtggtgtatgagccggacttggtgcgtttggtgggtttcaaacccatatcttcgaacagcaccttctgcagctgcttggggctttgcaggttgatttcggtgccggcatactcccaagccatttcctgcgcttggcgagcctcggcggcaaactggtcacgcatggagacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcacgcagacgatgttcgttcggatcttcttcgacctgatcgtcgtcgaagtccaacgtgccttgcgaaggctgttcggtttcggtgaagtggatgtcgaggaagtgctcggccgcctgcttgaggctatcggcatggaaatccggttgggccagatacccggcaagcttggtgtcgaacatcggcaggtccatgtcaagatcgaccgcgcccaaaagatgcagcaattctttatacccatgcacgatggtgcgggagtgttcgcttttcaggaaccgcgcaagctgtgctcgcagggtatcggtgattggaaggggcactatggccgctgatgttgccgtggccacggcaatggcttgtgccgtggcacgccccggcctttcgtcgccccatgcggccacggtccaagcgtggccgaccgcgtcgccgcagatggcatgccgctgcgagccatcgccatagtcggaaaccgtgaaatcggcgatttcaccgggaaccttgacttcgacgcgatgggccttgacccattcgtcgaactgctccggagcagtgatgctcgtgggttccggcaggttcagatcgaggctgctatcctgctcgttctgctcattattcgtagactcgccagctccggatgtgttggatgccttggccccggtattgaaggttttcagtacacgactcttggtgcgaggtccgaattcaagctccttgaacagggcgtcgatctgtgccacgtccacggtgccgaatgtcagatcctcgatatcgacgcctagatcgacgtctcgtaccagtgcgttgactttgcgattgagtttgacctggtcgatattggcccgcagtgattcgccttttttgccgccgatttcatcggcgtgctcgcaaatgccgtcgagggaaccgaattggttgatccacttggccgcaaagccgtcgcctacgccgggcacaccgggaatattgtcggcggtttcgcctcggagtgccgccagatccggatattgtgcgggagtgactttgtatttgtcgatgatggactgcggcgtcatatgcttcaggtctttgaagtgatggcccgggtacaacacggtgacgttgtcatccaccagctggaaagcgtctcggtcaccggacaataccagtgtgtggtaaccggccttgtctcccatggtggcgagggtggcgatcacgtcgtcgccttcgaatcccggcttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcatcgatcacctgcgcgagcatggtggcaaaaccccagacggcgttggtggcctggccgctggaggtgctgaagttgtcgaccggcagggcgaaaaatgcacggaaggccagcgagtggccgtccaccaccagcaatgtttcattggtgggtacggtcacgctggcctctcccatagtgtgtttgtgttgctttacgactcagtacggcgacgccgataatcagcgttcgcccgaatcagaaggcttcggatcgccgtacttggcgatgatggcctgagccaggcgcttcttggggatgcgctggtccatggaggtcttctgaatccaacggaaggcaccctgctcggagaagtccgccttgtccatcagcagacccttggcgcggtcgacgagcttgcgctcctcaagcgtgtcttcggccttcttgagcttctcttcggtttccttgagctgatcggtggtttccttgagcttacgttcgctgcgctccacgctgtccagcaaatcgttgatctcggcgaaacggcccatggccacctcgagggtcggcagcagcttggattcctcgtacggcttggtgacgtatgccatggcgccagcgccggtggccttcttcaccagatcggtctgggagaatgcggtgagcatgacgacgggggcgatgttttcatcgcagataatgccggcagcggtgatgccgtccatacgcggcatcttgacatccatgcacaccacatcagggcggtacttgcgggtcagttccacggcttcctcgccgttggcggcctgaccaacgacctcataaccgttgtcttccagcatggcgaccagatccatgcggttcacggcttcgtcctcggccacgacaacggtacgcggaccgtcctcgggcttggccttgcgctcagcaggttcgctttcattggccacggccttgagctcttcgtcggtcagcacctcatcgatgttgatactcggttcttcggacttcttccttgcagccatgccaacctctttcttgaattacccaacaatggggttcacaataatttcagcgaactcctaactaaagtgccctcggtgggactcgaacccacactgcgcagattttgaggctgcttcctctaccaattgggatacgagggcgtgccaaagcactctgaagagagtagcataccaattcgactcttgcgacacaagacacgcgccaatcctccattcccccccccggtgaaacaggcgaaacacgtcgatatcgcggacggcgcacccgtgtgttgcccgttctcctgcgtggtttcaccgcttacaatgggctgtagtttcgatgtatcgcttttgttaggagggcttatgagcaacgaaacttaccgtcagttcgatccctggcgcccctctccggtcaaggagatttcccgtagacagattgtggagacgcattatttcaatgtcgatcacgtctcctatgagtcgaatcaaatcggttcgtttgaacgctactttgttcaggagaacaatggcgacactgtggctgtgctggccgtcaccgatgatggcatgattccgctggtcgagcagtatcgcatcgccaaccatcgttggacgttggagattccggccggtcacgccaacaacccgtccgaacgcccgaccgatgtagctaagcgcaagctggccgaagaggccggtttcgacgccaccaagcttacgcagttcacccgttttatgaacacgccgagctattccacccagcacaccgcaatcttcttcgccaccggtcttaccccggcttcccgtcaggaaatcggcccggagactccgcgttccgacgtgcgtatggtgtcggtggacgatgcctatgagatggtggtcaatggcacgattgtggatgccaagaccatggtcgccattttgcgcctgaagagcggcacgctcgatcatctcaacgactgatcgccacgctcgatcaccgcggtgactgtgggccattgcaatcaccacacaatcgcaacataacagataacgaaagcccccatccactttggatgggggctttcgtgtgctatatgctagctgtcagcagctaccagaagcctgaaatcagtcgcaagcgccaacggtgtgcacgtagatggagtcagtgcggcccggctggtgatcgccctgagcagagctcaggatgacgatcttgtcgccgtcagcaaccttgccagcatccttgaggaccttgtccgtgtagaccatgagatccttgcgggacttgtcgtggtagtcctccttgagcaggaaggcttcggtgccccaggacagagccagccagtggtaggtgtgctcgttgctggtcaggccgtagatcggggcggccggacgctcacgggagacgcggtgcacggtggcaccggtctgggtgtaagcaacgatggccttggcgttgagcttgtcggccaggtccacagcggcggaggagacagcgccggtggaggacatgtcaaggttcttgagctccgggatacggtcgaagccgtggtcggtggcgtagccggagatacgggccatggtggccacggtcacatccgggtacttaccaacggcggtctcgttggaggtcatggtggcgtcggagccgtcgaggatggcgttggcgcagtcggaagcctctgcacgagtcggaaccggggagttcaccatggagccgaggacttcggtagccacgatgaccggcttggcgtactggcgagccagctcgatgatgcgcttagtggccagcgggacctcttccagcgggcactcaacggccatgtcgccacgggcggccatgacgccgtcgaaggtcttgacgatctcttcgaggttctccagagcctgcggcttctcgatcttggcaatgatcgggatgcgacggccttcctcgtccatgatctcgtgggcgcggtcgatgtcggtggcgaaacgcacgaaggacatggcgatgatgtcggcaccggtgcggatggcccaacgcaggtcggcctcatccttctcggtcagagccggcagggagacggcgacgcccggcaggttgatgcccttgtgggaggacacaggaccggccacgacgaccttggtgtacacgttgttgccctcgaccttggtgacctcaagacggaccttgccgtcatcgatcaggatcgggtcgcccgggtggcaatcgcccggcaggcccttgaaggtggtggaggtgatgtgctcgtcgccctcgacgtcatcagtggtgatgacgaattcctggccgagctgcagctgaaccttgtcttcgccatcggcgttcttcttgaaccaaccgcagcgaatcttcgggccctgcaaatcaacgagcgcggcaacgttgcgaccagtggcttcgctggccttgcgcacgttgttgtagaccttgaggtgatcctcgggggtgccgtgggagcggttcagacgagcaacgtccataccagcttcaacgagcttcaggaggttgtcgtaatcctcggtggaaggaccgatggtgtctacgatcttggctttacgcatgaatgcctgcctattcttgttcaatttggttcgaggcgcgattgccccatttgccgaaacccagtctactagcgcgagccgactcatgacaagttttcttcacggtgtgttgtgagcgctcacattgttgtgttgactgggtttaagggttgtattctctaacgatttcaggccttttcagcgctttccatgctcttcatcttgatcacggaagccacggatgcgccgccaattgcgagcacaatcacagccagcgacagccatgtgggcacctccggcacccaatggacgccttcgccgccgttgatgaacggcaaggtattgccgtgcagggcctccatgatgagcttgacgccgatgaagcccagcaccacggacaggccggcaggcaggtagacgagcttgtcgagcagagcacccagcaggaagtacagctgctgcaggccgagcagtgcgaacacgttggaggtgaacaccaggaacggatccttggtcaggccgaagatcgcgggaatcgagtcgaaagcgaacatgacgtcggtggtgccgatggtcaggaacacgatgagcatcggggtccagtaacgcacgccgttcttggtggtgcgcagcttctcgccgtcgtagtcgtcggtaatcttgatgatcttgcgcagattacggatgatgccgttctcgtgatattcctcatcttcatcgccgccgagcaccagtttgacggcggtgtagatcaggaaggcaccgaacaggaagaacacccacgtgaagcgggagatcagggccgcgccgatcagaatgaaaatgccacggaaaatcaaagcaatggtgatgccgatggacagcacatacttctgaatctgcttgggcaccgcgaagttcgacatgataatgacgaacacgaataggttgtcgatggacaacgagtattcggtgagccagccggaatagaactcgatggcgggcttggagccggcgaagaaccagatgcatccgccgaagatcagcgccataaccacgaagaaggcgatatgctgcacgcattccttggtggagggcacatgcggtcgacgcccgatgacgaacaggtcgacgataaagaacaacgcgagcaccacgaaggtgatgatttcaaatgcgagtggggtttctgccatgattccctacactaacttatgtatgtgacggttttggggccgttccggtagcgccgatcgccaggcagtcagggtatgtgttgttcgacacgctccgggccgctcagcccaagtctttacggtcgacaacgcatcccctgactgcccgcctcgggtatgggaatttggttacttgttggcttccgtcatttgacggagttcttttttgaggtctcggatctcgtcgcgcagacgggccgcaagttcgaactggagttgttcggcggcggtgtgcatctgttcgctcagttggcgaatcaggtcggcgaggtcctgcgcgggcaggccggccttcaggatctcctcgtggcgtttgtctgcctcgttgggatcgagtaccggcacgcccaggtgcgtgttgccggccttgcccgcgttgcggtagccaccttcaagcaaggtctgggtgtccacatcctccttggcgagcatgtcgttgacgtcgctgatcttcttgatcaggggcttgggatcgatgccatgctcctggttgtaggcaatctgcttggcgcggcgacggtcagtctcgtcgatggcttgccgcatggcttcggtggtctcgtcggcgtacatgatcaccgtgccggacacgtttcgggccgcacggccgatggtctggatgagcgaacgataggagcgcaggaatccttccttgtcggcgtcaagaatcgccaccagcgatacttccggcaaatcgaggccctcacgcagcaggttgataccgacaatcacatcgatcttgccctcgcgcaacatgcgcagcagttcgacgcggcgcaacgtatccacatcagaatgcaggtattcgaccttgatgccgcgttccagcagatagtcggtcaagtcctcggccatcttcttggtcagagtggtgaccagcgcgcgctcgttcttggccacacgggccttgatctcggcgagcagatcgtcgatctgccccttgaccgggcgtacgtcgatcttcgggtccagcagaccggttgggcggataatctgttcgaccaccccatcggacagtcccatctcatagtcgcctggcgtggcggacaggtacacggtctggccgacgcgctgcaggaattccggccatttgagtggtcggttgtccatcgcggagggcaggcggaagccgtgttcgaccagcgtgcgcttgcgggaggcatcgccctcgtacatggcaccgatctgcggcacagtgacgtgtgattcgtcgatgaccagcaggaagtcgtcagggaagaagtcgagcagcgtgtgcggcggggtgccagcggcgcggccgtcaaagtggcgcgaatagttttcgacgcctgagcacacgccaacttgggtgagcatttccagatcgtaggtggtgcgcatgttgaggcgctgcgcttccagctccttgccttgtttgcgcagttctgccaggcgttcgtcgagttcctcgcgaatggttttgagcgcccgttccatgcgttcggggccggccacataatgggaggccgggaagatgtggacttcgttttcctcgtcgatctcgtcgccggtcagcgggtgcagcgtggagatgcggtcaatctcgtcgccgaagaattcgatgcgcacggccagttcctcgtagacggggatgatttcgaccgtatcgccgcgcacgcggaaggtgccgcgcgtgaaggcgatgtcgttgcgcttgtactgcatggccacgaattggcgcagcaggtcgtcgcggttgatttcctgcccgactttgaggaagagcatgcgaccggcgtattcttccggcgtgcccaagccgtagatgcaggagacggtggccacaaccacgcagtcgcggcgggtcagcaggtttgcggtggcttggtggcgcaggcgctccacatcgtcgttgatgttggagtccttttctatataggtgtcggtctgcgggatgtatgcctcgggctggtagtagtcgtagtagctcacgaagtagctcacggcgttgtccggcatgagttcgcggaattcggcgcatagctgcgcagcgagcgtcttgttgggctcgataatcagggtcggtcgctgcagcttttcgatcagccaggcggtggttgcggttttgccggtaccggtggcacccataagaaccacatcattctcgccgttttcgatgcgttcggccagttcggcgatggcctgcggctggtcgccggatggcttatatggcgatttgacgacgaaaggcttgtccgcgcgctcgatattgaatcccatagggcctcatcttagcgacctgcgcaccatcctgcgtatatctcacccacttgggccagcatctcgggcaatggatgggtggagtcgatgacgatatcggctatggcccgccgctcctcctcactggattggtggcggatgcgggcctcggcctgttccaggctcatgccgcgttcctcgaccatacggtcgagccgcatgcacacgggagcttcgaccgtgacgatatggtcaaaggcgaatggaatatcgtcaatgacctcggcgagcagtggaatgtcgtgaatgatgatggctgcctcggggtgctcatgctccagtcgcgccgcctcggcatagatcaatgggtgctcgatggcgtcgagccgttcacgtgcgcccggcgcggcgttcgcgccgaagacatgatcggcaatccatggccggttcatagtgccatcggcgagcaatgcatcaggaccgaactcggcgacgatctgtggcagcgccactcccccgggttcgacgatctgatgcgccagcgcatcgtagtcgatatgcaacgcgccgagttgcttgagttgcgccgccaccgtacttttgcccgcggcgatgccgccggtcagtcctattcgcatcatggtgcccatgatagctggcgctcccctcggccggctatcgccgacagctcccctcagggaggggagccggctcgcgtagcgagactgaggggagtcattggcggataactccaaaaacacaagaaacccggcccaatcggaccgggtttctttacacgctaagcgctagcttcgcggcaaactcacttgccgagcagctggtcgcgcagggcggcgagctgatcggagtcggcgagggtaccggtagccggagcagcggaagagtagttggaggtctcctcgaccggcttctcttccttcgggccctggccgtcggcggctgcggattcggcagcgttctccagctccttggccacgaactccttgtgctcctcccacagctcgtgagcggcggcgtactgagactcccactcctcgcgctgcttctcgtaaccagcgatccactcgttggtgttcgggtcgaagccttcggggtacttgtagttgccctgctcgtcgtactcggccggcatgccgtagatggccggatcgaagtcctcggaagccgggtcaacggagtcgttggcctgcttgagggacagggagatgcggcgacgatcgaggtcgacgtcgatcaccttgacgaacacggtctcgcccggcttgaccacggtctccgggttctcgacgtgacggttggcgagctcggagatgtgcaccaggccctcgatgccgtcctcgacggagatgaagacaccgaactggacgatcttggtgaccttgcccttgacgatctggccgggaacgtgggtgcgagcgaagcgctgccacggatcctcctgagtcgccttcagggacagggagatacgctcacggtcgagatcgacgtcgagcacctcgacggtgaccttgtcgccgaccttgacgacctcagacgggtggtcgatgtgcttccaggacagctcggaaacgtggatcaggccgtcaacaccgccgagatcgacgaaagcgccgaagttaacgatggaggacaccacgccctcacggatctggcccttcttgagctgggacaggaaggtctcgcggacctcggactgggtctcctcgaggtactggcgacgggacaggaccacgttgttgcggttcttgtcgagctcaaggatcttggccttgatcttctggccgatgtacggggagaggtcgcggacgcgacgcatctcaacgagggaggcaggcaggaagccgcgcagaccgatgtcgacgatgaggccgcccttgacggcttcgatgacggtgccctcaacgacgccgtcagcttctttgatcttctcgatgtcgccccaggcgcgctcgtactgggcacgcttcttggacagaatcagacggccttccttgtcttccttggtgacgacaagggcctcgatggtgtcgccgacctcgacgacttcgtcaggatcaacgtccttcttgatggaaagctcgcgggaggggatgacaccctcggtcttgtagccgatgtccaggaggacttcgtcgtgatcgatcttgacgacggtgccctcaaccagatcaccatcatcgaagttcttgatggtggaatcgactgccttgatgaagtcctcttcggtgccgatgtcgttgatggcaaccttggtgacttcagtgttgttctctgccatgtaaatatatggtttctaatagtggatggataatttctcgatattcagttatacgcacaccctacaggcatacagatactcacaatacaagcaactctgcccaaatttcctaggaaactctaggcgtgtcgttcggccatttccacgacgttggctaggagcatggctcgggtcatgggacccacgcctccggggttgggggtgtaggcggaggccttgtcgtagcaggccttgtccacgtcgcccttgatgcggtagcgaccggcttcttcgtcgtagacgcggctgacgcccacatcgaccagcacggcgccgtccttgattttgtcgggcgtcacgaatccggccgaacccattgcggcgacgatcacgtcggcgcggcgcatgtggtcggccacatcccgggtaccggtgtggcacagggtgacggtggcgttgacggcgttgcgcgtgagcattaggccaatcgtgcggccaatggtgatgccgcggccaagcacgcacacttccttgccgttcagatcaatgtcataggcgtcgagtagctcgagcacaccgcgcggagtgcaaggcagcggcgtcgaaatgtcgccgcgcacatgcagcaccagttcgccaaggttgtacgggtgcatgccgtcggcatccttggccgggtcgatcatgtcgatgatcgcgttctcgttgatgcccttgggcaacggcagctggacgatgaacccggtgcaagccggatcttcgttgagttcgcgtacggcagcggcgatgtcgtcgaagctggcgtccgccggcagttccttcttgactgaggtaatgcccacttcctggcaatcggcgtgcttgccggccacgtacttcatcgacccggggtcctcgcccaccagcagcgtgcccagccccggttggatgccctgcgccttgagcttgttcactcgctcggcaaggttggtcttgatttcggccgcaatctgcttaccgtcgatttttgtggacatcaacgccctcccctgtagtttcggtgcattctatcgaaacgataggctatcgttggaacaagtcaggattatatatcgttcgctctcacgaagaaggcgtgccatggggactcaaatcacacgacttacgcgactcgccgcagccggcctgagcgccgtcctgttgttcgcgaccaccgcatgcgcagccacctcccccgctgaaaccgagccggacaacaagaccagcgttcccgcaccgaccgggccgatcaatgtggtggcctccctcaatcaatggggctcgctggccgccgagctgggcggcgatgatgtggaagtcacgtccatcgtgaactccaccaatgtggatgcccacgatttcgagccaaagacctcggatgtcgccaagctgtccaaggcccaaatcatcgtggccaacggtgcgggctacgattcctgggccaccaaatcgatgaccaagaccacgaatatcgtatccgccgcttccgtcatgggtgccgtcgagggcgataacccgcatctgtggttctccaaagacgctcgatccagcatggccacggccatcaccgatgcatatataaaggcactccccagcaagaagaaggccttccagaagcggctcaaggcatggcaggcggacgagaaatcgttggaaacatgggcgtccgagttcaccaagtcccactccaacctcacctatgcagccaccgaacccgtggtctattatctgatggccgatcttgggttcaaagatcagacgcccaaggggtatacgcaatcgaccgcttccggcggcgaaccggcacccgcggacctgcagtctttccagaaactcatcgaagacaagggcgtggatgtgctggtcaacaacacgcaggaagccagtgacgcgaccaatatgatcactggcgctgccggtcgcgccgatgtgccggtagtcgacgtctccgaacaaatgcccaaggacgccgacacgctgaacgcctggatcaaccagctcatcaacaccatcatcgacgcggtggatccaagctatggctgcgaagacgccacggacggcgataccgcggacagcaacgcgaattccgatgattccagcgccgaaggctccgccacggatgatgccaatgcgcaagactccaaggccagcaccggttccagcacggaccccaagtacatccgtcagtgcaaggcggccgcatccagtgactcatctcaggattcggcaaaggccgatgccgccaatggcgattccggcgatgcctccggcaacgaccagaccgactccggcaaatagttagaagcaaaggacaccggcatcggattcgtgccaatgccaatagacgccttgcatgagaagggttgtgcgaccattgtcgagatggccgcacaacccttctctttggttatcaccatccgtacacgatattgagaacgattgtcagcatcgtttgccacaatcgggcgttatgagtgaaacttccgattgcatcgtgttcagcgatgccgccatcaagcgtggcgaccatatcatctggcagcatggcaccttcgccattcccaccggttcggtcacggccatcgtcggcaccaacggcaccggcaaaaccacgatgatgagggccgagctgggccttttgccgctctgtcatggcagcctgaccgtgctgggcaagcccgcaggcgagatgaacaaacgcatcggatatgtgccgcagagctatgtggcgaatgtcgattccaatctcaccgccgaacaatccgtgttgctgggcctgaccggcacccgattcggcatccaccccatcaccaaggcccagaaagccaaagcgctcgaggcgatggagttcaccggcatcgccgacaaggcgcggtaccgtctgtccgaactgtccggcggtttgcgccagcgtgtggccatcgcccaggcgttggtgtgcgacccacaactgctgatgcttgacgagccgttggccaacctcgatctggccagtcagcgcgccaccgtacacgtgctggccaagctgaaccgcgaactgaacatgaccatccaggtggttgcgcacgatctcaatatggtcttgccgattctgaccggtgccgtctacttgctcgacggtcacccgcactacgccgatatgcacaaagtgctcgactccgacctactcacccacctctacggcacacaggtgcaggtggtcaccactccgcagggagacatgttcgtgaccccgacgccggatgagctccaggaccagccgcaggatatgcacacggcagccgaagtggcgcaattgcaccatcacgagcacggcaatgccaccaatggcagtgccgccatcagcgccgagaatcgataacatcaagcgagccgacccacagcccatcaacggactgcagctcaggcatggagaaaatacagagacatgagcaccatcaacttttcgtatgatcccgaatggctggatacactgtccgctccattcatgaccaacgccttcatcgccggcctgtgcattgccctggccgccggtgtcatgggatacttcaccatcgcccgtcgttccaccttcgcggcccatgcgctggcccatatcggtctgccgggcgcgaccggcgcggtgttgctcggcctgcccgtgtcactgggcatgggcgtgttcgcactgggcggcgcactggtgatcggtgctttgggcaagcgcgtttccgagcgtgaaatcgccaccggcaccgtgctggccttcgccaccggcttgggtctgttcttcgcgcgattgtcgagttccgcctcccagcagatgcagtcgatcctcttcggctcgatcctgaccatcaccaccggccagatcatcggcttcgccgtgttcgacgtactgctgctggcattgttggccatcatctaccgcccgctgctgttcagctcgctggatgagcaggtggcacaggccaagggtgtgccgatcgggctgatgaacgtggcgtttatggcgattatggccggtgtgatcaccatcgccgtgccggcagtgggcaccttgctgattttcgcactggtgattacgcccgcggccaccgccaatattctggccggctccccattcaaggcgatggtgatcgccagcgtgctgtgcttggtgtcgatttgggccggactcgtgctgtcggcgatgttccccgctcccccgagcttcatcatcgtgacgctttccaccctgttctgggctatcgccaaagccgtggagacgatgcggaagtaatctcatccattttttcttgcccccgctggcgaattcatagcgggggctttgttatatcttctccaccaaggcattggcgatggcggcgatgccttcgccgcggccagtgaatcccatatggtcggtggtggtggcggtaaccgataccgggcaaccaaccgccgcagacagggcggcttcggcttcagcacggcgtgtgccgattttcgggcggttgccgatgatcgccaccgaggccgatgccggcgtatacccgttggatgccagatgcgccacaacttcttgcaacatatcgatgccatgcattccggcaccatgcgcgtccgcaccgacaccgaacagtgaaccaatgtctcccaatcgggcggcggcaagcaacgcgtcaatcagagcgtgcgcggccacatcgccatcggaatcgccttcgatcccctcgtatttggcggcatcggcctcgctgcatgaatcaggcaccggccagtagagcccggcaatccacagttcacggcctgagccggcaggcgcaaaacggtgagcgtcaaaaccttgccctatcagcactcctgcagaccccatgcagtccccttcgatggcgttgcccagacgaacggcagcaaacgattatgaatcacgaagccccggcgcatcgcataaggacacgaccggggcctcaaaacaatcaaatcacttcttcttggacttcttctcggcttcaacacgagccaaagtatcggccgcggcctcttcgggctcggcggtgtgatgcttgtcgtcaccgggctgagcgggctcgtagcccagattcacgtcgagcagacgctgggcttccgcctcgtcgatcttctcggacaaggcgatctcagaagtcagaatggcacgggccttggtgagcatgcgcttctcgcccgcggacaggccgtgctcgtcgacatcgcgctgggcgagatcgcgaaccacttcggcgatcttgttgacatcgccggtggcgatcttttcgacgttcagcttgtaacggcgagaccagttcatctctttctcgatgatcggggtccgcaggatgccgaacaccttggccacttcggatgcggagacgatgtcacgcacaccgaccttcttggcattgtccacgggaacgttgatgaccaaaccatcggaagagagtacggacaactgcagatattcgcgcgtcactcccttgaccgtccgctcggtaatggcctccaccttcgctgcaccatgacgcggatagacgaccatatcgccgactttgtaagacatgtaccctccgagaactgacggcttacacacgaaaactcgaataattatgccatgcggtctggaccacccctatgagagcgctcacaaccacggaaacacaacgaaaagggcaagaattcgccattttcgacgcgccaatgtagcgtttacgactccaacgcacgtagactttgggtcatggctgaagaaacgaagatcaaggaagataccgtcaccgtgcctgtcgcccaaggcgacctcgatgcggtgagcaatgctgaattctacaatccccacggagttctcggcgggcatctcggcatcggcaagcatgccgacaccgccacaatccgcgtgctgcgtccgcttgccaagtccgtgaccatcctcacccaggatggcgaatacccgatgacccacgaatacaacggcgtgttcgtggttaccgtgccggcttccggcactaagaagcagcccacgattcccgactaccgtgtcaggaccgagtgggaaagcggcgcagtgctcattgaggacgacccatatcgctatatgcccacagtcggcgacatggacacctatctgttcggcgagggccgtcacgagaagctctgggagacgcttggcgcgcatgtgctgcgctatgacgatccgatgggcggcgcagacggcacgcccggcgaacaggtggtaggcaccgcattctccgtgtgggccccgaacgcccatgccgtgcgcgtagtcggtaacttcaacgcttgggatggccgccgtcatgccatgcgcgagctcggctcctccggcgtgtgggagatcttcatccccggaatcggcgcgggcgagacctacaagttccagatcctgaacgccaattacacgtgggagatgaaggctgacccgatggagcgtcagcacgaagttccgccgaacaccgcctccatcgtcaccgaatccacctacaagtggaacgatgacgcctggatgcagcaccgccgcaccaccaacccgcatgatggcccggtctccatctatgaggtgcacgccggcagctggaggcagggactgacctaccgcgacctggccaagcagctcgtggactacgtcaagcaggaaggcttcacccacgtggagttcatgccactggcccagcacccgttctccggctcctggggctatcaggtcaccggctactatgcggtcgactcccgtctcggttcccccgacgacttccgttacctggtcgaccagttccatcaggccggcatcggcgtgatcatggactgggtgcccgcccacttcccgaaggatgccttcgcgctcggccgcttcgacggcaccccgctgtacgaggacccggacccgctgcgcggcgaacaccctgaatggggcacctatgtgttcaacttcggacgccgcgaagtacgcaacttcctggtggccaacgccctgttctggcttgaggacctgcacgtcgatgcactgcgcgtggatgccgtcagctccatgctctacctcgactacagccgcgaacccggccattggcgcccgaacatctacggcggacgcgagaacctggaggccatcgacttcctcaaggaggccaccgccaccgcgtacaagaacaaccccggcgtcatggtgatcgccgaggagtccaccgcatggccgggcatcaccgcccccacttccgccggcggcatcggcttcggcatgaagtggaacatgggctggatgcacgacaccctcgagtatctgcacgaggagcccatcaaccgcaagtggcaccacaacgagatcaccttctccatggtgtacgcctactccgaacactacgtattgcccatcagccacgacgaagtcgtgtacggcaagggttccctgtacggcaagatgccgggcgatgactggcagaagctggccggcgtgcgttcgatgttcgcctatcagtgggctcacccaggcaagaagctctccttcatgggcaacgagctggcccagtggggcgagtgggatcacgacgcctccatcgattgggattgcctgaactggcaggagcaccgtcaggtccagaccatggtcgccgaccttaacgccttctacaaggcgcatccggcactatggagccaggacttcgacccggccggcttccagtggctgaccagcgacgatgccgaccacaacacgctgagcttcctgcgcatcggtaccaagggcgagaccttggctgtggtggtcaacttctccggtgaggcctggtccgattaccaggtggcgctgcccaccggcggcaagtggaccgaagtgttcaccaccgatgacgccaagtacggcggctccgacatccacaacggcaccttcgaagcggtcgagggcgaatatcattcacgtccgttctcggcgaagatcaccgttccggctctgggagttgtattcttgaagccggaagactgaactggtcaacaggctgaaaggtaaccggtttatttatgctcaataccacagcgcgtcagaatacgacaccgcgcacggtgctggtggtcgaggacgagcccacgctcgccacggccatcgcccagcgcatcaccgctgaaggatggaccgctcgcgtggccggggacggcgcttccgccgtccaggccgcgtcccagctacgccccgatctggtgatcatggacatcatgctgccggttatggatggtctagaggccaccaaacgcatcgtcgccgaacgtccggtgccggtgctgatcctcaccgcacgtgatgacgaggccgacaaggtcatcggtctgggagcgggtgccgatgattacatgaccaagccgttctccatgcgcgagcttatcgcccgctgcaaggcgctgctgcgccgcgtggagcgtgcgaaggtcatcgccaagaactcggagaacgagaagctgctcgacttcggttcgatggtcatcgacccggcccagcgcatcgtcaccgtgaacggcgaacaggtgcatctgacccccaccgagttcgatctgctggccacgctggcccgccgcccgaagtcggtgctcacccgcgaaaagctgctcgaagaggtctgggactgggtcgacgcatccggcacccgcaccgtcgacagccacgtcaaggcgctgcgccataagctcggtgccgataccatccgcaccgtgcatggcgtgggctacgctttcgagccgccgaccgcgtgatggcatccaaaaaacaacagcaatcccggcttgatgcgatgaaacctcgcgtcaagccggttgatttgttctcatctctgaagctggaactcagcgcactgatcgttatcgccactgccatcgcgtttgccatgtgctggttcctcctgaaattcggctggtccggttggatcgccatgccgctgactttggtggtggccttgggcatcacctattttttctctcgcggcatcaccgctcccctacgccagatgcgcgatgtggccgaagccatggcggatggcgattacacggtccgcgtggatatcgatcaggatcgtcatgacgaggtcggcaagctggctcgctcgttcaacgagatggccggcgaactcgagcatgccgataaaatgcgccgcgacatgatcgccaatgtgagccatgagctgcgcacgcccgtttccgctttgcaggcgatggtcgagaacatggccgacggcgtcaccgagcccactcccaccaatctggagagcatcctcacccaaacgcagcgtctctccgatctcatcgccttcctactggacctgagccgtatggaggccggtgcggcgagtctgaatatcgaaaagttcaacttcgccgactttcttgacgagaccatcgagccgttggaaatcgccgatggtggccacgcccacgacatccgcgtcaccgtgccggccgacatcacgatggaaggcgatcaggaccgcctgcgccagctattcaccaacatcatcgccaacgcgctgaaacattcggccgacggcaccaccgtgctggtcgacgcccacgaggacgaaaaccaaggcaccatcgtgaccaatgtggtgaatttcggctcccagattgcaccttccgaccgtttggacatcttccggcgctttgtcaaaggcaagacgggtcccggcaccgagtcgggcggcaccggtcttggcctgtccatcgcgcgctgggcggcccaattgcacggtggcaccgtcaaagtggtcgacgacacgcgaggtgccgatttcgaaatcatcctgcctaaatatcacatcgccgaacgctgatattgtccgacgtcctaccgtatactgtattcgaacagatgttcgaatacagggtgggaggcgcagcatgacacagcaatccgagtcacaggccatggcgcacgaggccacgctgtttgttatgcagatggccggcgattccatgatcaatgcgggtattcacaacggcgatctgctgattgtcgatcgttcgttggcaccagtccccggagatgtggttgcggctgtcatggacgacgaaatcgccatcaagcggctggtttcacgggccggcatcaccatattgcacgccgagaatccgcgataccccgattacatgccgagcaacggcgcttcgcctgctatctggggcatcgtcaccgatgtcattcacccgttgatatcgtcatcggaccgtcgcaccacggcatccgccaataccagcacgcccaccaccttggtgccggcctgctgaaacgcctgaacgcattgccgcacagtggcacctgtggtgacgatatcatcaacgagaagcaccgcgtcgccattgccgatgagatcacgcttcaccctgacatgaccggtgatacgacgggcacgctgtgccgaagagacctgctgcacggagcgtgccttggtggaggagctcagggcattgcatggtcgcgcatcgacgccgtacccacgcaatgcccctgccaccgatttggccaacggtgccgtatgggcacgtcctcttcggcgcattgacgcccgcgatgatggcaccggaaccaccaatacgcgatgacccaagcatgatgatggtattggcgtcttgttcagcagcgacaccatgatgcggccgaacgggccgtcaagctcggtatcgtcgtggtccttccagtcgagaatggcacgacgtaccgctccctgataaatcgatgcggaccatatacgggctccgccaccactgtctgcatcccgttcccggcattgcgcgaacagggcccagcatgccgcacacaatacctcatccggcgcgtcacacccagcgcagccgcgtggaaacagcagattgcagacctgtgcccacatcgcatgccaccacttgtatacgctcggcccgtccataacgcgtcactatcgagctggagtatcgaatcgcgcaagcagtgcatccagcagttgtaccgtatcttgcggattctcaacacgaacaccgatcgcaccggcctcaaccgcgggatagtcattacccgtaggcgtcatgcgatcacccacgaacaccatttcatcggcccgtatgccaagtgtctgcgtcagcttgcgcacggcataggccttatcgatgccgcattcgctgacatccacactggtgtatccgccggccttgacccgcatatgcggcagatcggccttgaccgcttcgaccagcgcctgtttcttcgtgttatcgcgatcccatgcctgcttggccgctacgggcgcgaactgcccaagagcggagaaggtgatctggctgcccctgttctcgattcgaggcccccatacctgctgttcccacaatcccagttcccaggcatgtcgctcaagactttccgagacagcggccacggtggcttcggacagatcatgcgcatacaccaaggcccattgcgtgccatcccaccggtaataccgggagccggaggtaggcatgacatgcagattgccgcgcctggcattcggggtgagtacatccagcacctgcgaggtgaccaccgccatgccgccccctgagatcagggccaccaccgtatggtcgagcaacgcacagaaccgttcgatcatcgcgggcttcatcggctgttttgagctggccagtgtgttgtccaaatcgaaaccgaacaccttggcgttggagcagacattatcgaaatcaagttcggaccacgaacgtaccaccatttgtcgtgcctccctcgttgacgaatgttcacagccaatgaaccaatcctaacgcatgttgcctccgccatgccctatggtgggaaccatgcttcagccaccttggaacgcacgaatctaccgcaaccgccacggtcgcggcacacgaaccccgatgttcggcacccgtctgccccgttaccgcactcgcaccggcatgttcgacgatatggtggcggcccaggttcgcaggctcggccaagcgtggccggaactgatacgtccgctccagttcgcggtggaggatgtgccgccttcggatccgacgccttggcagaccgagccgaatatgacgtcccagtgcttccccgccagccacggcattcccgcacgagtcgtgctctaccgcatgccgttgcagaccgaggcacctaccaagctcgaactgcaattggccgtcagggatgagctggtggcccgcatagcggaattgtatgggcgcaggcccgaggaaatcgaccccgactggggcctgtgacaacactgcgggccgtgtcacttgtaataaggtagtggcacggcccgcagctatatcgccgccgaaacatcatcaaactgacgcttcggcgagcatacccttctacttgacgatggaggaatcgttccgagcccagacatgaaccgtggcgggcatcagcgttgaagcgtcgatgacggacaatccggcgatgtccttgtcttgcaacgaatcgtgactgaaccgcgctccccagctcactttcttggatgagtcctccaacatcagcacgaccgcggtgccatgatcgccggaaagattgccggcttcaatcgtttgtgctgcgttcgcatccagtgtgatttccttggaggttaccgaagcaccggcatcatcgtaggcgcgcaaggtgaccgtcctgcgcgcattggacgtattggccagcgtgatggaggcctttactccgtcgggaagggccaaccccgagaattcggatggctcgccggcattgaccaatgcgaaatcggcttggccggagtcaccggagcgtgtggccttgacggagaacgacacggcgtcctctgcggtggacatcacgcccaacgccccatcaggagcttctcccaagtcgatcgccgtcactttatcagcagtgacggtggcatctttggcgggaaccaagcctttggcggtaatccatgacagcccggtgctggtgtctgccttggcgaacagataagcggtgaccgcatcgccggcagtgatggacggcgccaccgatgcattggatgcggtcggcagcggcagcgcgaaatcagaacccttcggtgtcagaccatccatggtcaccgtgcgcaccacggacgcgataggagtctccttgctggaaacggtcacgaacagaccatgctgcccatcgaccgcggcggacagttccatcgaggactccccctcggctggcacagacagcgtggattgggtggacaatgccattttcccggctgtctcggaaccccagacggcaatgtcgacggtggtcggcttggtggagagattcgagacgatgagctgctgtgtggtaccggtcgtgctgtcggagagcaggaacgactggctgagcgaggtcgatacgcaggatgccgccgatatgcctctcacatcgccatcatcggcccatgatgcgatggtgccgacggtgccggtgccagctgcggcctgcagcatacgggtattgatcagacgagctccctgattgatcttctgagcaccggttttcaccgaggaatcgtcggtcgaatcggcgtctttcaaagttacgtcatctgaactggacttttgcccgatcgccgagacagtggcgctgtagacggagccgaacgccgcatagcgcgcttgtgtgctcagattgccgacagtggcctggaaggcgctgtcgccgtacgtgccggtatcggccaatcctataggtgccgggcagtaggtttcggactgggtcggactaacggtctggtcgatggcattatcggaagcggccaccttatccacccagatattggggatgggggccatgacgagaacgacgaacagcgcaatcaacaccagcatggtgatcacaccgagcacgatgccgatcgcacgtttgaaaccagaagttttgttgctcatgcctgctcctccaatccgtaggacggtcgtctgcgaggcatggcgaccaagcagtacaacgccgtgatcacacctaggcatatcagccaggcgtgcctccagacactatgctgtgcacgttgctgccatgaggtatccacctgctgtgaggcgctgctacgcagcgtcagacgatagtagctgccgctatccgtggagaccagggactgggtgccgttcgatgcggcgatattcgcgctcaactgttcatacggcatgtcgttcaaggaatcgccggtctcgggaaccacgtagatgccgccgaatccaagcgcgctgatggccgcgatggcctcttcgtcgggattggacagcagcgaggcacaggcctgggccagttgttcgtcaaccgcatcatgcttgccggacagcaggcgcgcccgctggaccggagagctgtcgatcaaatcgccgcgcgaggtgcgcatcaccgcatagttgacgatgttgcgggtctccgcgctcacggcaagcacacgatgatcggcaccggcctccagataatcggtggtgaccatgggcaggccgttttcagacacgcccagtcccgcatccttatgacgttcgatgccatacatgcattggatgccaatgcagcacaccagtatcagagcaagcaccacacggccagacacgatgagcacatgcagacggtcctttttcgatgcgggatcactgccagacgcatgcaacggttggaatcgcttcaccgccccaccagcgacgagacacacgcaggcgaggaagcccaatatcatcatcgcgatgcccggctgcgcggaaccggccacgacaccatcggcatccacggttatggccacatggctggagaccagggcgagcgcgcctccgcagacgattaccacccacatcagtcgcgaggtccgcaacgcgaacggcagcaccagcgaagcaagagcaagcagcgtgatgacgccaaacagcacagtgaccgccaaatcggcataatcagtcgaccccattcgccatcccagcgcacgctgtgcggcctcaagcagactcagcgacgccggcgacccgttggcggatgacgttggcaccgtgatgtcgccgaacagttgacgccacatgcccaaatcggcgtaacgcaccgcattgacgagcgtaggagccaccgcaaaggcggcaggaaccggaattagcaacagcatggcgcgcttgcgacgcacgaatagcaggaacatcaggaacacgacgatcagcgcgaacagcagctgcggttcagcggccaccacagggatgaagcacagtgcggcgatggccgcggcctgaacggatgtgcgcggcttgagcgggtcttcggtatggtacatgcccacggcacggaacacgaatgcgaacgcggccggcaggaacaccattacggtaagcatcggcatattggcctgcgcataccagccgaacataatgccggtggatgcccacagcagtcctcccagcacacgaaccacgtccgagcgggtgaatacgcccgccagcgcccagaacgacaatgcgctcagcggcgcggccacaaacagtatcatcgccaaagcggcggtcacatggccgagcgtgaccaacgaggccagcatcagcaccagcagccacggcgtgggcggcgcaggaatgccggtgccgctgccaaacacccacggcgtggtggcggactgcaccagttgcgtgaagctggcaccggtgggaagcaacacatcggaatacaacgatccgccggagaatatcgaacggaacaccggccaatacatcaccgcgatggccgcaaagcacaccagcgccatcaccacggccgcactccagcgatatatggtgcgtgtccgcagatgggcacgttccagcggactgagcagcactctgccctgctgggattggaatgcatcccgacgatcatggaactgcttgatctgctggctgtctgcgaacaagacatgcagggacgatgcggcgaccttcgattgtctggccaccagactgcgtgatttcatgtttcccgcgatatcggccaaggccagccatggcaggcacaattgcacccatgcttcatacggcttcttgccgaacatcatggatatggccatgccaaaactgcggagcagcctccacagccagacgataaaccaggacgacatggccaggtccgtgtacagataccgctgttgggagcgatgcaccgtcatcgcatgattgaccgtgtgatcgtccttaagcggttccccgcctcgcgtacgaatgccctcataccgtgcgcgacgatgtgatatctccgcttgcgggacaaccaccacgcgtccgccgctcaggcagacacggcggcagaaatcaaccgattcgctgtaggtggtcagccaggcattgatgccccgcagtcgcgtgaattgcgacatggacaccagcgcgcctgccagcgacaccgcaaacacatcctgccgcccgtcatactgctcctgatcgggttctccatcgaccaccagggaatgcacggcgtggtgacccgcatacataccgacatcatgcagatgggagccttcccaatcgcactgtttgcacccgagcacactggcgcccggcgtattgcgccacgcctcaagcaatcgttcaaggcatgagtcatccgaagggcgggaatcatcatggagcagccacaatgcgcggggagcgtcatccagatcggcacgatccaatgcccggctgaccgcatcgccgaaggagcgtgcgcccttggccgagacgatgtgaatggtcacatgcttggactgcggcacctccatcaccggccccgatggcgaggggatgacctcgaacgaggtggttatcctcgaactggtgcgcccggtcgcgtcggcgatgatgacgacccccggaagaacattctgcgtcaataccgaacgcaatgtagaccggaggaaacgcatatcctcctcaacggtgatcacagccgtaatgccggtatccacatcctgcctatgcgtatatggtcgagaagacatggcgtcggccaacgcctcatgaatatcgctattacctgtcggactcataaactcccagtgtacgcaccagacttgaagggggtgtgtggagctacgcccgctcccggtgctctcgcttatatcgacggcgttcgcgctcgctcatgccaccccaaataccgaatcgctcatcatggtcgatggcccatttcaggcattgctcacgcacttcgcattttgcgcacacacgtttggcatcacgggtcgagccccccttttccgggaagaacgcctccggatcggtttgcgcgcacaacgccttgtgctgccaagatacatcgccatcaggtcggaatagtccccacaattcgtgccatggctcttcggctgaatcgtcgaccacaccccacatgcgattctccttgcctattgagcttttcatacggactaaattacacacatgcaatttcggttttgtcaaattctttctcgtgtcattacatcatttttatggaactgtgtgctatggcgtgaacgcgatgccctgacgccgttgcacatgatattgtgccgttcctgcgcaggaacaccatagcgcaggaacacccggcggatgctgtgtcaaagtgtcattcagacaatcgacagtttcaggaggggttatgacgcaggaatcaggtggggcggatccgcatatcaacccgccaagcttcattcctgcgggaaatcgacgcacccggccttccgggcaggtgccacgctccttcgcccccgcccgaacctcgcgccagtcaggtcaagctccatcggcccgtccgtccgtcacgggaaatgacatcgaagagcctcaactgaacgccaacgccacggcaagcgccaacgtcgcggacaacggcaggcggactccgcccagtttttctccgaaaaccggacgcgccactcgcagcacggctccggatgccgccgcaccgcgcagcattccgccgtcgcgagcgcggatgtcttccggctcatcccgcaacgccgtgcgcaatccgtcggatatgccggtttcccggccctcatcgccagcagcaaacgtgtccacgaagttcagccatcttggccggccggcggcggcaacggcgaaaacggtaacggcacgccgtccgcgagccttacgcatcaccctatgcgcaatcgcggtactggtggcggcgttgattctttccgttttcggtgcctggcaatgggtggacagcaaactgaatcggagcgactggctgaccgacacccccaacacgccggcctcgacttggctgattcttggctccgatgagcgtgacggttccaccgattacggcggcgtagacaatatctctggcttcaggaccgatacgattctggtgctgatcaagcccaaaagcgggccgagttcgttggtttccattccccgcgattcgctcatgaacgtcgataaccagtacatgaaaatcaatgcggtggcgctgattgcgggcaagaaggctttggtaagcaacgtcgagcagatcaccggccagaaaatcgatcatgtggcacagatcaagttcggcggtctgcagaacgtggtgaacgccttgggcggtatcgaactgtgctatgacgaggatgttcaggattcctattccggactgaactggaaggcgggatgccatacggcggatggttccaccgcattgtccttctctcgtatgcgatatgccgacgcgcgaggagacttcggacgcaacgaacgccagcgacaggtcatctcggccatcgtcaagaaggcttccagcagtgagaccctgaccaatccgtccaaaatcgtggcagtgtccaatgccgcgatgagcgcactcaccgtggacgagaagaccaacccttacacgttgctcaccatggcgttggcgttcaaaagcgccaccggctcgaatggcatctccggcagcgtgtactggtccgaccccgattattacgttgatggcgttggttcctcggtgctgcttgacgacgccaagaacaccgaactgttcaatcaacttgccgacggcacgtataaggccggcaccgtgggcaatctggcggaaggctgaccgacgctttcccggagcccatcggcttcatcatcggcgcatgatcgtcaccgttgcctacaccgccaatcatgcacgggcaaaatgtcatgtggataactcggcaagctagaaccacataccttgattcggcttgcgctttcggcatgcgttcccccacgctggaagcatgacatcacagcagaacgattcgaagcgacattccgtccatacggcatccgccgtatcccgggcgaagcaccgtttgggcgcgccgccattgcgcgcccgcctgaccatgtttgccgcggcatgcccgatgatcgcgcaggcattgatgatggtcatactgctgttgcacgggcaatggctgttcgccgccatgatcgcaccgggcatattcgcctgtctcgtgtccctgctgctgacgctcccctcgcctccaggcccggagaaggctcccgatccgcaacaggcaacgatcgatgtcggtatcacgggcgacgccgatgaccgcgccgcagacctccgtcatgcgccgtcgcagccgatagaatcgctgctgcacttcgcacgcctgccatggcgcgccattgtgggccgctggcttgaaccccttgaccttgcggtgccgatcggcatgaccggaagcgagccgctgatgctcgatctgaaccgtcaggggccgcatgctctggtggccggcaccactggttccggaaaatccgtgttgctgcaaagctggtgtctggcgctcgcctcgatgaacgggcctgagcatctgaatttcgtgttcttggatttcaaaggcggttccgcgttccgcaaactcgaacggttgccgcataccgtgggcagcgtatgcgatctggatctggcgcatgccgtacgcgcgttgcgtgcgctggaagccgaactgacacgccgtgaacagctgtccgccgctgtccatgcttccgatatccgcgatatggtcaatccaccaccgcgcctgatcgtggtcattgacgaattccatgccctgaaggaccagctcccggattatgtgaatcgtctggtgcgtattgcctcgctcggcaggtcactgggcatgtatctgatcgcctgtacgcagaatcccatgggtcaggtcagtgccgatatgaaggcgaatatgtccgtcagcatttgtttacgggttcgggaccgtctgcaatcatgcgagctgcttggcgatggtcgtgccgccgacctcagtccggcaatgcccggtgcggcgttctgcaacgattccgaacaggtgacggcattccgctgtgcaacggcacgcgatatcgatgcggtgtgccgccagatcgcgttcgcatcgcggttcgtcggaagcccgccgcaaccgtccctgtttaccgcgccactcccccggcacgtaaaagaccggactgtggccgaccacgcaccgcaacgcattcgatttggacttgccgacgatggcatcaacctgcgagaggcgacggtatccctcaccggtggcaatatcggtgtcatcggcccgcaggggcgcggcaaaaccacgttgctgaaaacattggctcgacacgccagcatggctgatggcttggcggtacgtgtcagttccccgcatcgtcgggtatggagctcgcaatggcttcatggcggccgctgcacgccgtatgccagctcggatgcaccaccgcctccgcatatcgtgtggttcgtcgacgacgccgatgagttgttcgacccattccgcaccgacgagcaggcgctgtctttcacacatgcgttggccgatgagtccgtcagcgtggtattcgccgtcagcacgattcgcccgatacgtataccggagcattgcaataccagaatcgtgttcccgtgcggggagagaacgtccgatcttatggccggagtccccgctcgcctattggatatgatgagtcatatcgatgccgacaacgcgggccgggccgtgctcatcgagggcacatcggcatgtctggtgcagtgcgcttcgtgaaaacttcggttttttctcggcaaaacctcttgaaaatcaccacggttcgtggttaccttggtactggacttaaggaacaacaccagccacggggcttttaagggaggcaagcaatgagcagcgcttttgattggcgagccaaggccgcatgtcgtgacaaggatccggaactcttcttcccggtgggcaacaccggtgcagcctatcagcagattgaggaggccaaggccgtgtgccgcacctgcaaagtgattgacgcatgcctgaagtgcgcactggacaccaatcaggattacggcgtgtggggcggcttgagcgaagatgagcgtcgtgcgctgaagcgccgcgccatgcgcgcccgccgttctcaggccatgcagatgcaaatctgatgttttgattatcgcttcgtcatactaggaaaccctcccgcttgggagggtttcctcatttcgggcttcgcatcactcgtcctgagcagccctgagcttcatatcaagcaccacgcgggtgccgccttcgcggcgcggctcccaatgcacggaaccaccgaaatcattggtcacaaaggtgttgatgatctgcgtgcccaaaccggaaccggaagaacgagccaatccaccctgttcttcggagccgagaccggaaccgtcatcctcgaccaccacattgaggttcgggccggagcggcccacggaaatcgtgatatggccatccttgcggccttcgaacccatgctccaccgaattggtgatgagctcggtcagcacgagggacagcggcgtggcatcctgagcgggcatcatgccgaacttgcccatgtagttgatatcgatgtgctggtctttcatcgtggctaggtccacggccatgcgcagcaggttggcgatcaccttgtcgaagtcgacgacctcgtcggcggtctggctcaatccctcatgcaccatggcaatggtctgcacgcggcgttgcgcctcctgcaattccttcttgacctcatccgacttggtcttacgagcctgaagcctcagcaatgcggagacggcctgcaggttgttcttgacacgatggtgaatctcggaaatcgtagcgtccttggtctgcagctcctgctcacgacggcgcagctcggtgacgtcacggcatagcagaatcgctccgatacggccgttgttgtcatacaagggcaacgagcgcatcgagacggcggaacggttggcgttgagttcggagtcgaccgcggctttgcctgtcaacaccaacggcagggtttccggaacagggtcgttctccttcaatagctgtgtgccgagttcgctgaggtaatggccaggcatggtggtcagcagaccgagacgcctaaagcagctgatggcgttcggggctgcgtatcgaaccacgccgtccatggtcaggatgatgaagccgtccgccacgcgagcgatatggcgttggctcatcaccgaatccttgtaggggaattggcctcgcggaatcatctcgtacagatgcttgccggcgttgatgctttccgactcatatcggccgttggattctcgtgtggccatattggtctcacgcacgaccaagcccaaggtcttgccattgtgccgaaccggcgcgtacacgttgcagacggtcgccttgcccacggttctcaataccgtggagcggaacaccacgctggagagcatggcggcgtccaattcgccgaccatgtcgtccggcatgacgtttcccaccacgtcttccgcccgcagcgtcataacggtggatggacggcattgctcggccaccacgtatttgccatcgccatcctgtaccagcagcagcagatcggcaaagctcaaatcggcgatcacctgccaatcggcgacaagatgatgcagccactcgcggtcctcgtcgtcgaagtcggggcgcgttgcaaggatatgtgaaaaatcagccatatccctatcatacgcagacgcaccgccgccgtcgcggcaagccacacgggcaagtacgacgactatgacgacatcgcatcttcaataccgcgccaatcgcgttgcacggcttcccgcccgtggccaaggtgccggcatgttgcttatcgtacacggcaagcatcacgtacagtttgatatccgaagccgccaccatattgccggcattgctgtgtccatggaacccatcatcgcgtttgcctgcgctttgacgttgtcatcgccattgtcctgggccgcaagatagaccggcagatagaaatcggcagccacgaattgcttgccggactgcgacgtggtcgcgatggtggcgtcctctgaggagtcggcggatgttccatcgatgaccatggcggagacggccacatcggaggacgagtatgaatccgcgatgtcagacaactggctggatgtgatcaccggagtggaaggcttcgacttctccgtcgagcttttcttggacgaatcgtcgctgttcttgtctttggcgctatcagacgtgttcttcttggccttggacttggcgtcagaagaatccgtcgtgccatcatcggcggaatccaacgcatcggccccggtcgactgtgccgatgtttgcgcctgcggctgagctccccacaatcccatgctatgggtgatgaacaagccgatgactaacgccacgacacaaatcagcgcgatgagcacaatcaccaccgctttggtgtgatcgacgccaggacgcccggcgggaggttcaggagaagcaggggccgccggattggcctcgggctgctccaatgggcttccgcactgcgaacagaaggcatttccttgctcgttggcaaacccacactccgtgcaatacaccatcgccgagccctttattgctgcgacgttctcatcttcggattccatagtatcgccgccattgggtgatagtgttcgcgcgagtcggtattgacaagcataaaagttacgctaacgtaggttacggcagcgtaagaagcgtatcgtcaactcgtgaaacgggggcatcaccatggcatcaacaaccggcgactcggaaaagacgatgcatcacgacgctcataacagcgcgacgattgcagaggatgccaccatcgcatccaagcgtcaggcggctatcgaggcgcgcgaacaggcgttgcaggccaaggctgatgccgtacgggccaaggcccagttcaaggccgaggccattcgagccaaagccgaggagaaggcccggcacaagctcgccaaagcggagaaccgtgcgctgaaaatcgagggcattgcccctgcggaagtggaacgcaagattcgtctcgacgtgcacggacggccaaagccgttgatgcgcggctggattcacgcgattgccgctcccctgtcattggcggcaggcatcgtgcttatatgcttggcacatggcgcgagtctgaagtgggcgtgtgccgtgttcatgacagcgtcgctgattctgttcaccaattcggcctgctaccatctgggcgattggagcccgcgcgtcaccgatgtgctgcggcgtatcgatcatgtcaacatcttcctgctcattgccggcacgtataccccggtttcgtttgcgctggaaccgttctggcgcaatgtgatcatcatatcgatgtgggcgtgcacggccatcgccatcgtgattcatgtgatctggatcaatgcaccacgctggctgtatacggtggtgtacatcatcttcggcatctacggcctggcttatatggtgatgttctggaattcgccgtatgcggggccagccgtggtggtgctgctgtgcgccggcggtgcctgctacatcctcggcgccatcgtctacgccttgcgcaagcccgacccttggcctcgcgtcttcggattccatgagattttccactgcggaacggtggccggatatgcctgccatatggtggccatctacatggtgatcgtctcgctgtggcaataagcgctacgacatataagtatgcccccgcctacgggggcataccagtcacttaactcaggccagcggcttggcggccttgacagtcacggacagctcgcggccgttcggtgcggtgtaggaaacgacgtcgcccaccttggcgccctcgatggccttgccaatcggggaatccggggtcatgatgtcgtagtcggtgccggccacgatgtcacggctgccgagcacgtaggtcatctcgttgccgttgagctcgatggtcaccacagagccctcgcccacggtgccttccggagcattctcgataatcttggaatcgcgcagcttgacggtgagctcggtgatgcggccctcgttcttgctctgcgcctcacgggcggcctggtagccgccgttctcggacaagtcgccctcggcacgcgccacggcgatcttgtgcgcgatttcctcacgcagctcaccttcacgatgggcgagctcttccttcatcttgttgtatgcttcctgcgtcagcaggtagaccttgtcctcagccatatcgtcctcctgaaccgttgtcgatgctgaaacaatcttcgttatttatgacaaaacgccggctatgaccccggcgttcgtcatgtgctgacctatggtcagcgggtggaaatgatgtcgatgacgaacaccagcgtgtcctcgccgccgatgccggcctgcgggatgccgcgggaaccgtagccgtattccggcggaatggaaaccaccagacgcgaacccacgttatggcccggcacagtctggtcccagcccttgatgacctgtcccacgccgatgccgaaactggcgggctgatgacggtcgaagctggagtcgaatggggtgtccttaccccacaccacgccgtggtagttcacggtgacggtgtcgccgcgacgcacgatcgggccgtctccctcggtcagctccacaaccttgaggcccttcggggcttcgggcgtcgggaactcgataacgggcgtggtgccaaattcggcgttcacctgaggcatctgatctgtcattagtcctccttcaaagacacaatgcgccctaccttagcaccatcggcgaatcggcggtagtccttcatccctgtgcgatacgacacgctggccgtatacgtcaattccggtcatcatgctggtgaataccggacatgtcaatcagcattcgacgacattgacggcaagtccacccttggaggtctccttgtatttggccatcatgtcttcaccggtctgcttcatggtttcgatggcctgatcaagggtcacgatgtgtgagccgtcgccgagcatggccatacgcacggcgttgatggcggtgttggcggccatggcattgcgctcgatgcatggaatctgcaccaatccgcccaccggatcgcaagtcagacccaagttgtgttcgatgccgatctcagcagcattttccacctgttccggcgtgccgcctacgactgcggcaagtccggccgccgccatcgaacaggccgagccgacttcgccctggcaaccgacttccgcaccggaaattgaggcgttgcgtttgaacaggtatccgatggcaccggcggtcagcagaaacgtgaccacgccctgttcattggcgttgtccacgaaatgccagtaatagtgaagcacggcgggaatgatgccggcggaaccgttggtcggagcggttacgatgcgcccgcctccggcattctcctcagagacggccaaggcgaagagatccacccatgcggcgtcggaagactcgagcacggcgtctttgcgccggctgtcgcggcgcagcacatcggaattcgaggcgagacgccgatacattttcggcgcgcggcggggtacgtcaaggccaccgggcaatgtgggttccgccgaggtgcatccgtggtccacacaggcgcgcataacacgccagatggcatcaatatcggatcggacctggatgcccgagcgtgaagcggtttcgttggcccatacaagttcggcgatgctgagatgatgttcccggcataacgacaccagttcagtgcatgatgagaacgggtagggtgcctcgacgccgaaatcagtggatgatgactcgtccgcatcggcaaaggaggcgccttccggagggcgttcatgaatgccgatcatcgggtcttcgggagcgcctttgcgcacgaatccgccgccgatggaataccagacctgttcgtcgaccaagcttgcggcggcgtcgaacgcctggaatcgcatgccattggggtgcgcggccatgcgcttccattgttcgaacaccacgtcacggtcgtagtcgaaatggatgcgtttgaggccggcgaggttcagagtatcatccaacgcgcagatctcgcggatgtgcatcatgtggtcggtatccacggtggccggcagattgccttcgagcccagccatcgcagcacgatcggtgccgtggccgagaccggtcagcgccagagaaccataaagcgtgattttgacacgtgcggtgcgatcgaccaaatggtcggcctgcaacgaggaggcgaaagcatgtgccgcgaccatcgggcctacggtgtgcgaggatgaaggtccgacgccgatggtgaacatgtcaagcacactgaacatttggctccttctcccctgctggttcggcatgccggtgttaccaggcgtcataccatcacgatatcgtatcccagcccagcgcccggaatcgctttcgccttgtgcgatgatggccgcgcgcgtcatgccggcgagcgataagtcagtcagtgagacagtgcggagaacatcatgaccagtacgatgataccgatgatggccaatacgatctgcaccaccatcagcccgatggtcagtcccttcttggtggcgattttgggcgcgtacgcctgtgccaacaggaaggcgatgaagccgaacaccgcgtagttgacggtcagggccatcacatcgccgttcgacaacaccacgccgttcagcggctggttcagcgtgttcatcatcgcgctcatcacgaacatgccccacacgccgtagccgattaatccgacgacgccgtacagccatggcttgagtttgtcgttggcacgcagggtcagggcttcggcacaccacaacagggcgaagccgacgatgtaggtgaacgccacggcgatcagtatcacgatagtcgcccatggcaggagtgcggccacattgccgatcatggacagatagaatcccgagcaggcgatggcaccaacggtgagtgcagtgcccgcaatgacggcttgggcaagcatggtgggcagtgcgccttgttcgactcgttcgacatcggtccagcgtgaagccatgtggattcctcgtttcatcaggtacatcgtcacaacgccacatagcctaacggccttttgtttcggccttataagctctccacatagtgagctgcgagccccctctgacgaggggggctgtcggcgaagccgactggggagagaccacggcacagccgcaaaaacggcatcggccacaggccgatttcaaggtgcctccggtgggactcgaacccacaagccgaagcgatcgattttaagtcgactgcgtataccatttcgccacggaggccaacttttctattataagctatctcctgccctgagcattgcttgcgggttgctgcgcttcgtgcagccgtcgcggcatagccgctcccttcgcctacaaacagcccaccgggctgtttgcttaacggctcagcccgctggaggcacttaccacttacgctattgagccagcaaccggcgaccataatcgagcacaatgccgtccagcagaccgtgttcgctggcaacgaacgaatcgatggcttcaccatgatcggccttggcggcttcgctgacacgcgccagcacacggctccagaccacagcgccgccgccgaccacatcgatacggccggggtggatggtcttgtattcgcggcgctcggcgcgcgtcatcctaaggaacttgtcgtccacggcataggcgtcttcaaggctcagccgatgcccgtcgaccacggtgtgatcgtattccttcaatcccatggccaaggcggtcatcgtggtcaccgtgccggacacgccaatgatggtacgggccttgcctgcgtccacggtgcggaaggcctcatcgatatgttcatcgacgtccacaacggcctcatcgatctgtgtctgggtcggcggatcattggtcagatgacgttcggtcatgcgcacggaaccgatgttcatggaaaacgcgccctgaacctgggtagtgggcgcactgacgccgtcgccaccgatgaccagctcggtggacccgccgccgagatcaaccaccagatagggggcgggcagatcgtcgcgattgaccacggaagtggcaccaaggaagctcaggtcggcttcttcggtgccgggaatgacttcggggcgcacgccgaggatacgttcgatctcatcctcgaactcctcacggttttccgcgtcacgagttgcagaggtggcaacgaaacgcaggccgtcgatgggatgttcggcaatcacaccggcgaattcccgagcggccacataggcgcgttccaacgcttcgtcggcaaaacgatgggtcttgtccacatcctggccgagacggatcacacgcaggatgcgcggcaccacctcatgcatgccatcggcatcgacacgtgcgattttcagtcgaatggagttcgtgccgcaatcaatgccggcgacggttacggattccttgctcattgccttctcctcgtatcccttagtgcgtatgaatggactgttcgcactggctcatctgttgatcaatcgtccagcgtgcagcggcagacggtcggatcgaattcgtctttgacgcgttccagtaccaaatcgccaatggggttgacgcccggccccataaccaaggactgggccagcagggcatgcaggcacttgacgcgcaccggcatgccgccggccgaagtgccttcaatatgctcctcactgtcgccaagacgtcctgccagttcgtggcggaatgccagatacaggttatgggcctgctcatatgcggccttgagctcctcgtccaaggccaacatgtcgttgtattgctgcatcacgccggcggcctcgacatgggaggcggccttgacggcttccggaccggtcagatagcacgtggtggggaaagggattccgccgggcaacaccggacgggtgattacggcaagtggcctaccgcagacgcatcgcgcccccacggcgaccatgccgcgcgggtatcggccgagctgacgctgcaccaggtcgatgtcatgatcgttggcgggctcggcaagcacggtatcgacaagggccttggccttggcggcgatatcgatggtcactgttgggttccctcccctgtgttctgttgggtattctgttgggtgttctgatcggattgggtgttctggtctgacttatcggaccgcttggatgagtcgttggatgacgagtcagaggaaccggaaatatcggatttgccggactcgctatcggtcacaggctcatcggcctttttgagcgagtaagacagttcgctgtaccatggcaggacttttttgttgctgctactggaatcttccgttttctgggattcgctatcggagccggtcacggcttcgggatgaagcacacgcacggcctgttcgccggggaatacgaagccgaggcgttcacgggcctgggcggtgatgtaggccttgtcatcccaacgcttgatgtcgttttccaactcctgcttttgggcaatcagcgaagcctcctcacgcttgagaccattgagttcggccaggttcagggcataggtgtggaaggtggagaccagctggatggtgccaagggcgataatgaacagggagacgaagaacgctataggccccgccgacccttttttcctaactcgtgctttgccggttttgccaggtttgccggtacgggacgacttgctcatgtcacacgaaaatacccgccgcattcgacttgacgaatacgacgggtatcgagcttcagtggaaactcacgcctttacgggcgtttcagctcacttggccaggtacttcttgcaggccttgaaggcgctgtagccggcgtactgagcggtggagccgagctcctcctcgatctcgagcaggcggttgtacttggcaacgcgctcgccacgggccggggcaccggtcttgatctggcgggtgttcttagcaacagccaggtcggagatggtggtgtccggggtctcgccggagcggtgggaaaccatggaggtgtagccgttggcggtggccagctcgatggcgtcgagggtctcagtgacggaaccgatctggttcagcttgaccagcagggagttggcggcgccgaggtcgatggccttctgcagacgagccgggttggtgaccagcaggtcgtcgccgacgaactgcagacgatcgccgaggcgagcggtgatggcagcccagtcttcccagccttcctcgttgaacgggtcctcgatggagacgatcgggtactcgttgatgaggttctcgtagtagtcgagcatgtaggcggagtcacgctcttcaccgtcgaagcggtacttgccggtctccttgttgtagaactcggaggaggcgacatccaggcagatgccgatctgcttgccaggctcgtagccggcggcggagatggcgtccatgatgtacttgagggagtcctcgttggacttcatcttcggggcgaagccgccctcgtcgccgaggccggtgttcaggccttccttcttcaggacgttcttcagggtgtggtagacctcaacgccagcgcgcagagcctcggagtaggtgtcgaagccgtacggggagatcatgtactcctgaatgtcggtggcgaagtcagcgtgagcgccaccgttcatgatgttcatgttcgggaccggcaggatgtggccgttggtgccgccgatgtagcggtacagcggcaggccggcggactcggcggaagcgtacagagcagccagggagacgcccaggatggcgttggcgcccagcttgcccttgttcggggtgccgtcgagctcgatcatcaggtcgtccagagcgcgctggtcagcagcgtccatgccgatgaccttcggagcgatgacctcgttcacggccttgaccgcgttaagaacacccttgccgccgtagacggacttgtcgccatcgcgacgctcccaagcctcggcctcaccggtggaggcgccggacgggaccaggcccaggccctgggcgccgtcttcggtgtccagaacgacctgaacggtcgggttgccgcgggaatcgagaatctgacgcgcgtacacgctttcaattactgccacaactactccttaaaacggttgtgtatcttgaatgacattcttaagagtagtgcgatttgtggacgttgtgaacaacacgcccaaaatttagcgttagcgctcacaatgccagtgtgccgcctgattgcaaggcagtacggacgaaatcgctcagtcaacgtccttgccattgaggtagtcgatttcactgtcggacaatttcagttcgctggctttgaacgagtcctgaatctcctgcgggtttctggccgagggaatcgtgaacagatattggtattgtgcaagttcccacgcgagcgtgacgcgctggtaggagcagtcgtgaatcttggcgacttcgcggaaccggtcgaacagatgctcgttgaacgggtcgaggaatccgccgagcggcgaccagcagacgaaagccaaaccgagcttttcgcaggtttccaacgtgtgttcagggtcgcggtggaccggggagaactggttctggacggccacgagacgatcgcccaaaatattgcgggcggtttcgatgtccgcgttgtcgattctggagatgccgacagctttggccacaccttcgtccacgagctgcttgagtgcgcccatctggtcttcgtacggcacctgcggatcattgcagtgcgagtagagcagatcgagcgtatcgacaccgaggcggcgggctgattccttggcattggcgatcatggtttcaggtcgggcgtcggcctgccagccgtagttgccgttgccgtcaagcgtgcgcagccagccggttttggtggctacgagcacctgatctttggggccatgccacgagtgcagagcatcgcggaccagatattcgccatagcccatatcctccggttcgccggtgccgggtgcgctgggcagataataggaccaagccgtgtccaaataacggactccggcatcgagcgcggcatggatggtctcgattgcctgatcacggttggaggggcgcccctcgatggcgagcgccatcgtgcccatgccaaggcggggaatctcatagccggcaagtgttgccgtggtcgcgctctggttcgtgcggctcgtagtcgtttcgctcatagcagtcacttaatctcgctcgctggacagtcggaacgattccgtctggggtgaatcatcgtcacaaacgacggcatgaatatgaatatggctcaccggaggttgcccggtgagccatagctggctcgactgtcgcctcgcaccccgtctacaaacggctctgccgtttgcttgatgacggggtccatgccaaatcatcaagtaactggttggtccagaggactacctggtcggagctcatggggccttggcctagggagccggtgaacggggtggggacgatgagctggtgggtgaccggacggtattgggtgcctttgtaaatacggcccatacgcatctggatggattcgggcgggtcgatgcgaccgatgcgcacgcggttggattgcgcgagaatctccgaaatgccgagcttgcgggccttgaacttcagacgggccacgtcgaacagggtctcgaattcgaccggcggcttgccgtaacggtcggtaagttcctcttccaaatccttcagatcggcctcgttgcgggcggaggcgagcttgcggtacgcttccagacgcagcttgtccgaatcgatgtactcgatcggaatcgacgcttcgatgggcaggtcgatggacacggccaccggctcgacgttctcttcgggctccttgtacttttccacggcttcggacaccatgcgtacgtacaggtcgaagcccacgccctcgatatggccggactgctcgtcgcccagaaggttaccggtgccgcgcaattccaagtccttcatggccacatcgaaaccggagccgagcgccgtgttctgcgcgatggtggcgagccggtcatgggactgctcggtcatcggcttggacgggtcgtacaagaagtaggcgtacgcgcgctcgcggccgcgaccgacgcggccacgcagctgatggagctggctcaagccgaaacggtcggcatggtcgacgatcagcgtgttcgcattggagatatcaagaccggtctcgatgattgtggtacacacgagcacgtcgatgtcgcgatgccagaagtcgcggatgatctggtcgagctgcttctcccccatcttgccgtgggcgatgccgacgtgcgcctcgggcaccagcgtgtggatcttgtcggcgatggacgagatgtcctgcacacgattgtggacatagaacacctggccgcctcgcagcagttcgcggcgtacggctgcggtgacctgcgcatcctcgtaggcgcccacataggtcagcaccggcaaccggtcttcgggcggggtggcgagcgtggacatctcgcgaatgccggtcacggccatttccagcgtgcgcgggataggcgtggcagacagggacagcacgtccacattggtgcgcagtgtcttcagcgtttccttgtgttccacgccgaaacgctgctcctcgtcgatgatgacgagtcccagatccttgaacttgattttcgggttcagcagtttgtgcgtgccgatgaccacgtccaccgtgccggtttccagaccctcgacggtctcgttgatctccttggtggtctggaaccggctcatggccgccacattgaccgggaaaccctcgaaccgttcgctgaaggtctcgtaatgctgctggaccaacagcgtggtgggcacgagcacggccacctgcttgccgtcctgcacggccttgaaggccgcgcgcagcgcgatctcggttttgccgaaccccacatcgccgcagatcaggcgatccatcggcacgggcttctccatgtcggatttgacctcgtcgatggtggtgagctggtcggcggtttcctgataggggaaggcgtcttccagctccttctgccatggggtgtccgggctgaacgcgaagcccttggcgcgctggcgggcggagtacagcttgatcaggtcgtcggcgatctcgtggacgtgcttgcgggccttggccttggtggccgcccaatcggagccgccgagcttgttgagcttgggggcttcggcaccgatgtatttgctgacctggtcgagctggtcggtggggatgaacagtttgtccgccggggcgccgcgcttggaaggcgcatattcgatgaccaggtattcgcgagtggttttgttggcgccggtgccgatggtgcgctggcgcatttcgatgaaccggccaatgccgtgctgctcgtgcaccacgtaatcgccttttttgagttccaccaagtcgatggccttgcgccggcgtttcggcgttttggccacggccacggccgaagtgcggccggtcaggtcgcgttcggtgagcagggcgattttggcggctttgtccacgaagccgtcgatggcctgagagcggatgacgtcgaaattggcgatgccggtagtgttgatcgcgcgcttgagtctggccaaggtgccggccgcagcggcggtgatggtgacgtggaagccggcgtcgagcaggccttcgatgccttgggaggccttggcctcatcccctcggaattcggccgggttctgggcgtcgagctgcacatggccggtcagcgtggtgtccacgccgaaactggtgaggcgaatcaccggatgttcggagtattcgagggagctgatggtttccgcatagtcgaggaagctggcttcgtcgaagctgatgggcgcgccggcgccgtggccggaagcggccacatgccagctggcggccaggaactcgttcgcggtttttgccaagtcttcggcggaacggcgcagtttctccgggtcgctcaggaggatcacggcatgcttgggcagcatggagcccaccggttccagatggtccacgagcgcgggcatcagggattccatgccttcgaccggaatggcgttggcgatggattcgagcatgtcctcagcattgggaatcgaaccgaccaaggctttggcgcgggcgcgcacggcgtcggtcagctgcagttcacggcatgcggtggcccagatggtcttgaggccgtcgccgtaggtacgctgatcggaggcgtggaattccttgatggtgtcaatttcgtcgccgaagaattcgatacgcaccgggtgcggtgcggtgggcgggaacacgtcgaggatgcctccgcgcaccgcgaactcgccacggtccatgaccagatccacgcgcgtgtaggcgttttcgatcagacgtttggcggcttcgtcgaggggcaggtcctcccccacggtgaacacgagcggctcgacgtcgcccagtccttggacgaccggctggatgagcgagcggatcggcatgacgagaatgcgaatcgggccgaacatcgaatcggtatcgctcggatgcttgagtctgcggaacacggccatgcggctggccacggtgtccgcgcgcgggctcagacgctcgtgcggcagggtttcccaggcttcgagctgggcgatgtcgttcgggtcgccatcataccaggagcgcagcgagcccacggtctcttcggcttcgcggccggaggccacgaccagcacgaccggcttgccgggtttgccggccacaccctggcctatggcggcggccaaagccgggcgcaagccttcggaaacaccggccaggacggagttgtcgacgtcgtccgaaacctcgatgtcgccagtggcgagcctaaggaaggtcttgtcctgttccagcccggacaggatgcctaccagtgagccgttgatcaggtccgggtgcgtcgcctcaccggccattgaacttctcctgggtcttggcaagaccgtggaagatgatgtcctcggcggcgtcggcgccgtcagccaggaattcgggcagctgcttgcgctggtccgggccgaagccgcccagtacccagttcaccgtgttgtcatgcgcgttcgcaccgcgcttggagtggccgacgcccatgcgcacgcgcgcgtatttcggcgtgccgagggaacggtcaatcgacttgatgccgttgtggccgcctgcggagccgcctgccttgaccttgatacggccgaattccaagtccatgtcatcgtgaatcaccacaatatggtcgggctcgatctggtaataggcgctaatggaagccaccgcattgccggaatcattcatataagtcagcggcttggccagaaagaacttgacggtgcggccgtccaggttcatcacgcttttaccgagcatggccaagcccttgtgatcggcgaagttcaccgtccaacgttcggcgagcacgtcggcggtcatgaagcccatgttgtgccgcgtgtcctcatattttttgccggggttgcccagtcccgcaatcagccagaaatccgatgccataatccgctcctcgtccgtcttcctttattcccgtatgcacgttctgtacgttccgtacgtcatgcgcgcgttcgcctcgcgcactggcccatgcccggccggatccaaccgtcaagattgtactcaacgccgccgtcaagctcgtttgctccggcatcctcacacttttcttgactgaaatgacttactgcaaggctacaggtccaaataccagtaggacatgtcccgcatggtgccggtggagtcggtggcagcggcgggcatgagtccgaattgggtgaagccgaagcggtgcatgagggcaatggagccggcgttatcggcgaaaatgatgccgcaggccttgcgcatgtggcgggccagcgcctcggtgagcagcctgtcaagcatgaacgtgcctactcccctgccttgccatgccggatcgatgtaataggccaaatcggtgacaccgtcatatcctgcgcggtcatagaacacggagagcgcaccgaagccaatgattgaaccgtcttccgattccacaacaaaaacgccgtagggcggcgtatgggattcgacccaggcgcggcgttggtcgaaggtgcgcggggtgaggtcggcggtcgcaccgccggccatcactgaggcgttgtagatgtcggcgatggcttggacgtcggattcgacggccggacggaaggtgtatggcatgaggttcctttgaatacgcaaatagcccgtccttatgataaggacgggctatgtcagttgaggtaaccgactcccttcagtcgccttcggcgatagctcccctcaccctgagggaagccaagttacttgtcgagctcgatggccttgttgagggcgtcttcaagctccttctgcgccttgccgtaggcggtccagtcgccgttcttcatggcggactggctgtccttcatggcttgggcggcatcgttcagcgcctgctggagttcggggctacggtcggaagacgagccggaatccgacttgccgtccgtggtgccggactggccaccattggtatcggaaccagattggtcaccggatatgccggacgactggtcaccagacgatccgtcaccggacacgttctcggcatcgcctgcggccgcgccggaatcaccaccgaacacctgatccaaggcctcatccaacgtatccgcaaatcctacctgatcaccgaacgcgaccagcgtcttcttgagcagcgggaatgaagtcgcacccgaagacttgacgtacacgggctgcacgtacaccagtccgccaccgagcggcagggtgagcaggttgccgcgcaccacttgcgtgtcgccggattgcagcaggttcagttccttggacacgtcggcgttggcgttgaagttgttctgcgcctggccggggcccggtacgttcgaatccttgggcagctcctgcaatcggatggtgccgtagttcgagcctatcttgcccttctcattgccggcatccgagtcgaccgacaggaagccggtgaggatctcacgggtggactggccagccggaatgtaggtggaggtcagcgagaacaccggttccttggtgccaccggtctgcaaggtcaggtagtacggcggctgcaggatgtcctggtcctgctgggactgggattcggtcgggtcgaccggcgtctgccagaagtcctcgccggagtagtactggttggcggaggtcacgtggtacttggagagcagctcgcgctgcaccttgaacaggctttccgggtagcgcatgtggctcatcaggtcgccggagatatcggagagctggtggtactggccggggaagatcttctcccatgccttgattaccgggtcggattgatcccatacgtacagatccacggaaccgtcgtaggcgtccacggtggccttgaccgagttgcggatgtagttggccttctgcgagcccaaggatgagaccgttgcggaagagacggtggtggaatccttggtggcggagccgaggtcggtcatctgcgagtatgggtaggcatcagaggtggtgtagccgtcgacgatccacttgacgcggccatcgaccacggccggatacacacggccgtcaagcgtcaggtacggcgccaccttggccacgcgctccttgggggaacgatcgtaaagaatctgcgattcgctggtcacacggtcggagaagagaatctgatcggagccgaagcggatcgcgtagagaatacgggagaacaggttgccaaccgaggggccgccgtcgcccttgaacgtggtcagggcgccttccgaaccggtcgggtagtcgaactcccaagcctgcgtgccctccggtgcgccgacgatcgagtattcggtggtgttcggcgagaagtagatgcgaggctcatacttttcggattcagtgagcttgccctgagtggggatgccggattcgaagaattcaggctggccgtcggcggtcaccttgttaccgtaagcggccaccacgccgtaaccgtgggtgtacacggtgtggtcattgacccaattgcggttgtcgttgccggccagggcaagctcgcgggcggcaatcacggtgtcctgggagacgccgtcgatctcgtacttgtcgactgccaaagtgtcggcgaaggtgtagtactgcttggactgctgcagctgtttgaatgtggggctgacgacctgcgggtcgagcagacgaatctgcgcggtggtgtcgccctccttggccagagcgccctgctcgcccttgtcggtcaccttgtattgctcggtcttgagcttgtcaagaccgtaggcggcgcgggtggcgtcgatattgcgctgaatgtaggtggattccatctcctgtgcgttcgggttgacgcggaagcgctgcaacagcaccggccatgccacggtgagcacaagacccaccacgaccacgacggcaatggaggtcaccggcacacgccaggccttgagcgcggcggaggcgcgcacgccgatggacgcctggccttcgagcgtgtgggaacgcatgagccagatgcccagcaccacgccgaggatggcggtcagcgcggccatgatgaaggtgacggggatgttggcatgcacggcggtgtaggaggcaccggtgatgcgtgaaccctgcacggtgagctggtcgaagacgccgatcatctggcgcactgcccaagcgaacatgttgagcatcagccagatgccaagctggcgacggcaacgcttggtgatggagaacaggccgcgtccgttaaccggcatagtaatgcggataccacccatcagcacatgagtgaccacggaaaacacaaggcccacgcccagcagcatggccacggcggcgagcacgagcttcaggcccggcagcacgaacacgtagaagccgttgtccagaccgaactgcggatcggtggtgccgaacgactgcgcgttgaacatgagcagaatctcgctccagttcgcgttgaactgagagccgaagatgacgccgacgatcagcgaaatcaccacggccacgcggcgagcggttttcgagctgacggatttgccgacctcgaccacatcgccgttaatgcgaatggtggaaccgtcggccgaatcagggcgtgctcgaatggccagccaggcggaaacgaagccggtcaaggccatgagcagcgcgtaggccacccacagaccgattttcaccccgagctgggtccagaccacggactggaagccgagctggccgtaccacatcagatcggtgatgaatcgggacaggccgaagaacagaccgacgatgatggccaaggccagcaccacgccgatcagaatcttgctgccacggctgcctcctgagccaccggacgctggcttacgggtgatacgcggattggccgagccacgtggagggcgggatgacccggaggggccggcgttggtgttgcgggccggaccgtccccatcggcctcgacatcgaggatgatcggatcgtcattgttcgcattgttgcgtcgtgaatcgccgccattgccgaacagtattgagaaaggatcgttaaaagacataactcaagcctatcgaaagggcgggaggtaggttatgccctgagcacagaatgaggcagcgttctgttctacgctccgttctacgcttgccggtatgaacagccaacggccacaacatatgcgtccctcagcacacgccacacgccaacttcggcacaggagcactccaatcgtggcgacaatatgtgctttggcagtggtgttggccggcgtggcagcctacggatggcatgtcggatggttcgccaaatccacatcaaacggcaacaccaccactccccagacctcccagacaagtgcgttaccacgcgccgacgttccttccccgaagaagaacgaaccggccgcacaagcccaacgtgcggtatccgccatgacacttgaggaacgtgtgggacagttagtgatggtgccgttgcttgccggttccgatccctcctcgttggcttcaacaatcgccgatgagcacattggctcggccattctcattggcaattggaataccggcgccgatacggtcaagaccgcgaccgcgcaactccaaggatatgcgccggccggcaatcgtctcatcatcgccaccgatcaggagggtggtcaggtgcagcatctgactggtaccggtttcgacacaatgcccagtgccgttgagcagggcacaatgtccgctgacgcattgcgtcaatcggcaggcacgtggggttcgcaattagctgctgctggcataaatgtcgatttggcaccggtgctcggcacggtggtgggcgatcgtgcctcaaatgctccgattggcgcgctggatcgtgatttcggattggatgcggccggcaacgccgaacatggcatcgccgttattgaaggtttgcgagacgctcaggtcggcgcggcggtcaaacattatcctgggttgggcgcggtaagcggcaataccgacttcaccaccgaaggcattctggatacgaccaccacgttgggcggggccgaggcaggtgcctttgaccaggcgatcaccaagaccgatcctgcgatggtgatgatgtcgttggccacgtatcaatccatcgacccgaataatccggcggtgttttcttctacgattatcgacggtcatattcgcaacgccctgaagtacacgggcgtggtgatttcggattcgatgtctgccgaagcgttaagcagctacgatgcaagccaattgggagtaaagcttgtcgaggcgggcggcgacatgtcctgcatcggtcagacggattacgtaaagccaattgtggacggcctcaacgaacgggcgaagtccgatccggctttcgcttcgaaagtgacggcggcggcgactcgcgtaatggcattgaaaatcaagatgggactggcctgactgcttatcctttgcactggtgaggattgatgcgcactgattcgcgctaatcctcaccagccctcgtacaaatgcacactagtcctcgtacgaatcgtcagtcctcgtatgaatacagaccatgcttgccgatgtattgcaccacgccgtcaggcaccagataccagaccggctcgtcgtgttcggcgcggcggcgtacatcggtcgaagagatggccaaggccgggatctcaagcgtatcgacctttccttcgggcaaggtcacgccgtccggactggagtagccggggcgcgtgacggccacgaagtgggcgaggtcccacatgaggtcggcgtccttccactgcataatttcggccacggcgtctgcgccggtgatgaagaacagctcggcgtcgggatgttgggcgcggatatcgcgcagggtgtcgatggtgtaggtgacgcccggacggtcgatgtcgacacgcgagacggtgaatttggggttggatgcggtggcgatcacagtcatcagataccgatcttcggcgttggtgacgtgcttgtccagcttgaacacaggtcggccggtgggtacgaaaatcacctcatcgaggtcgtatacccaagctacttcggaggcggcgaccaagtggccgttgtgaatcgggtcgaacgtgccgcccatgatgccgacgcgcaggcgcgtatgccagttgccgcgtgcggaaagcctgcctttgccatggctgctggccccggccggcgcggacaggtcagacatgcgccgttcggtttcgccttgggtgacggcaacgatttcggcgggctcggcggattccactgatttttcggactgaactgacgcagccgttttgtggctgtcggtaacaccactcatgcctggccgccctcgccggcggcgtcatcggctgattcggtttcctcttcgatttcgccggcggtgggattgtcttccctgggatcgatcttgcccatgtcttcatcccattcgtcctggaccacgcgacgaatctcggcgaaggtgggcagcgggaagtccggctggtagaggcggcggacctcggccacacgctcggtgatgcggatgagcgtgtcggtcatgccgtcaaggtcaccgtcgtgctccatctggctgtatttgccgatgtagccttccatgagctccatgtgttcgcgcacgatcttgagctgggcatcgtcgaggtccgcgacttcgggcgaatcggtctcgggccaaccgatgagcacggcgtccgcgtattcgagcgacgcacgctgggcggcggaggcgatgccgtcctcgatctgcacaaggaacacgtagcggacgatgctgagccgttcggccgcgatcttcaggccgagcttgggatcgttgaggtcgatgtcgggccgcagttcgcttgccttgtttgccgtgtcagccgtaatgttcatgttgccgtcctcgttcatgcgcgcacctgtcctgttccgtaaccgatccacttggtggtggtcatctcccgcaatcccatgggaccgcgtgcgtgcatcttctgcgtggagatgccaagctcggcaccaaagccgaacacgccgccgtcggtgaagcgggtggaggcgttgaccatgaccacggccgagtcgatgcgcttggtgaattcctcgatggccgcataatcctcggcgatgatggattcggtgtggcctgtggaatgcgtgttgatgtggtcgatggccgcgtccaggtccgacaccaccttgatgcccattttgagggccaggtattcggtgtcccaatcctcttcggcggcgtggttgaggtcaaggccctcgattgccgcgccggagatgatgccgtacgacgtggtgtcggtctgcagcacgacgttcgcctcggccagagcggcggcgatctgcggcaggaattcggcggcgacatccttatgaaccaatagcttttcggcggcgttgcacacgcccacgcgctgggttttggcgttgatgatgatcgggatggccttggcgagatcaccggacttgtcgatatagatatgcacgttgccggcaccggtttcgatgaccggcactttggagttgcgcacgacggcttggatcagacccgctcctcctcgcggcacgagcacgtcgatatggcctcgcgcctccatcatggcggtggcgccggcgcgcccgtactggtcgacggattgcaccagtgcggattcgaaaccgtgggcttcaagcaccggggcgatgacgcccaacgtggcggcgttagtgcgttcggcggcgtggccgcctcgcagcaacgcggcattgccggacttgaggcacaggctggccacgtccacagtgacgttcggccgggcctcgtagatcatgccgatgacgcccatcggcacgcgcgtctgggtaaggcgcagaccgttgggcaggttgtatccgcgcacgatctcgccgaccggatcgggcagggtggccacatggcgcacgccttgggcggcggcggccacgcgcggcacgtcgaacagcaggcggtcgagcttgcccgcatccatgccgttttccttggattcgagcatgtccagcgcgttggcggcttcgatgtccgcagcatgctcgtccaacgcgtccgcaatggcaagcaacagttcgtttttggcttcggtatttgcctgtgcaagacgctcctgtgcgcgtgcggcctgatcggcctggcggcacaccgcgtcgaacacctcaggactcaattcatcgctcataaaaaacaagagtaacccacaatgggccgcattgcccgtttcgacccatattgcaccgaagatagccggggatataagcgcggctccctctgatgagggagctgcgtacatccgcaaaaaatcagtgaatctggtccaggtcggggtagagcgggaagtcttcggcgagcttgccgacgcgggccttcagcgcggtcacgtcggcggacgggccggcggcgagcgcggtgccgatgatgtcggccacctcctcgtattccttcggtccgaagccgcaggtggccagggcggacgtgccgattctcaggcccgaggccaccgaggccgggcgcgggtcgaagggcacggtgttgcggttgatggtgatgccgcaggcggcgagcagatcctcgccctgctggccgtccatctcgctgttgcgtaggtcgaccatcaccagatgcacatcggtgccgccggtcagcacgaagatgccgttggccttgacgtcgtcggccagtagtcgttcggcaaggatcttggcaccgtcgaacgtgcgctggcggatgatctccgggtcgatgcggaaggtctcggggttcacgccgtacgcctcggcgtggtagaaacggccggggtagccttcggcgtatttgttggtcagcacggagccctggcattgcagtaccgctcgcggcacgaagttctcagaggcgatcatctcaaggccactgcgctggcggcccagttcggagtccagcagttcggcgatctcaggatcggtttcgcagatcggcgcgttgaaagcatcggttgccttctgcgcaaggggtgaagcggtcatgggtgctctttggtataagcgacaattgattcgccgttgtcgccttaccgtatggcccgtttgcagccggcctgtttcatgatatggccggtccccgttcgatggcaatggtgattttcgccggtgcgaccggtcggttatgcgagacggacggcccttctgcccacggcccacgctagactgatgtggattcatcatccctttcaggcagaaggattcatcgtgacaaccaccttccattccacccgtagcaccaccgattcgctgaccgccaagcaggcgattcgtaagggcatcgccgatgacggcggcctgttcgtttcggacgcgttgggcaagaccaaggtggacgtggcctccctgccgggcaagtcgtaccagcaaatcgccgccgaggtgctgggcgcgctgctgccggacttcacggccgaggagctgggccagtgcatcgccgacgcctacggcgaacagtggtccgacgagcgcatcaccccgctcaagcccctgggcgacgattacgtgctcgaactgttcaacggcccgacttccgcgttcaaggacgtggcgctgcagatcctgccgcgcttcatggcgcacaccacgccggccgatggcgacgcggacgagaagatcatgatcctcaccgccacctccggcgacaccggcaaggccgcgctggccggcttcgcggacgccccgggcaccgcgatcaccgtcttctacccggaaggcaaggtctcccaggtccaggagctgcagatgaccacgcaagccggctccaacgtgcaggtggccgccgtggaaggcaacttcgacgacgcccagtccgcggtcaagcgcatcttcggcgaccgcgccctggccgagcgtctcgccggcaattcgcacgtggtgctttcctccgccaactccatcaacgtgggccgtctggtgccgcaggtcgtctactacttctccgcttacgcccaactgctcgccgaccaggtgatcaacgtcggcgatgaggtcgagtttgtggtcccgaccggcaacttcggcgatatcctcgccggctactatgccaagctgctcggtctgccggtcaagcacctcgtggtggcttccgacaagaacaacgtgctgttcgacttcctgaccaccggtacctacaaccgccagcgcccgttcttccagaccatctccccctcgatggacatcctcatctcctccaacctggagcgcatgctgtactacttgtccgagggcgacacccgtctgatctccatgctgatgaacgacctcaacaagtggggcacgtacgagatcccggaagaactgctggccaagattcgtcagatcttcggcaccggttgggccgatgaggatcaggtacgcgagtccatcaagcactgttgggacgagaaccactacgtgatcgacccgcacaccgcctgcggctactacctgcttgagcagatgccgcgcgacccgctgaccccgcgcgtgctgctctccaccgccagcccctacaagttcccgcgcgtggtgaacgaggcattgggcttcgacgccaccggcaccgacttcgagtgcatggatgtgctggcccacgagaccggcaccaccgccccggccgccctgcgtggtcttgagaccgccgacgtgcggttcaaggacgtcgtggccatcgacggcatggaggactacgtggagaaggccgcccaggcgctgtgatagtccgctgacggcactaactgacaattcccaaccgatacatgctttaccagcatgtatcggttttttgttttctgatgtcacaagtcgaaggtccaggcatgttcaagcatgtccgagccttgtcacgcgcggctttcttgcggcttttcacctgcaacgagccaatggcgtgttgcttgttttttctaggaaggcgggaatcgccatgctgccggcgaacgggaaaatccatgtggtttgttaggttctgtttctgcaactgaatagtcccatgagggagtagacagcattgcggcgaagggctcggcccaaaccgcaatgtggcaagtcaacatcgtggccgtcggcagttccgttacggtctggctttgccttaaatgacgagactcatgtaccgcggagtatgcgatacatggtcgtcaacgattcgtttggctgcgtgccgccatgttgcgcggtacgcgagtgatattacgcgggtttcagtgcggtgtgtcaaccaaacgagaggaacatatgaccacggccaacgggcagacgcccgcaccattcatgcaggatgcgccagcagtcatcagcacgctgggcaccgatgcacatcaaggcctgaccagcgaacaggccgcgcacaacctgaaccagtacggtcccaacgccttcaccaagccgaagccggaatcgatgctttcccgcatcgtcaagacggccgccgacccgatgctcatcatgcttatgatcgcggcggccatcaccctgggcgtcaacatcacccgcgccatggccggcggccacgccgacattctcgaatgcgtgggcatcttcttcgccatcgccctgtccgtgacaatcaccgtggtgatggagagtcgcagcgccaaggcattcgaagcgctgaacgacatcaatgacgacacgaccgtcaccgtggtgcgcgatggcgaggtcacgctggtgtcgcagcgagacatcaccatcggcgacgtactgcagatcagcaccggcgacaagctgccggccgatgcgcgcctcatcgaatcgaacgatctgaccgccgacgaatccgcgctcaccggcgaaagcgtgccgagtgccaaagccgccgacgccgtgttcaccgacccgaagaccccggtggccgaccgcacgaacatgctgtattccggctgcttcgtgaccgccggcaatggccgtgccgtggtcaccgccgtgggcgacgacaccgagttcggcaagatcgcccgcgaactgcgcgccgccaacaccggtatgacgccgctgcaggagaagctcgcgaagctcggcaaggtgatcgccgtggtgggctcgattgtggccgcactggtgttcgtgcttcaggtgacccggttcgtggcttccggcaccgtctcgttcgacacgatttccgaggcgttcatcacctccataacgctgatcgtggccgccgtgcccgaaggcctgccgaccatcgtggccgcgtgcctcgcggtgaacatcatcaaaatgtccaagcagaacgcgctggtcaagaagatggtggcgtgcgagaccatcggctgcatcaacgtgatctgctcggacaaaaccggcacattgacccagaaccgcatgaccgtgatcgaggcgtacaatgcaccgggccgcgccttggagaagcccgagcagatcaggaaccgcatgctgctggagaacttctgcgtcaacggcaccgccgacgtgaccttcccgggcgccaccgaagccgaggccggcgcgatgccggaattcatcggcaaccccaccgaatgcgcactgttggtcgccgcgcacaagaccggactcgactaccggattcgccgcgagcgcgcgacggtgctccacacgtatccgttctcgtcggagaccaagagcatgaccactgtggtgcgtgacggcgacggcattaccgtgttcgccaaaggcagcccggagaagatgctcgacctgtgcgccgtcgacgccaagacgcgcggcgaaatcgaacgggaaatcgcgaagttccaggcgcagtcctgccgagtgctcggcttcgcccaccgccatatttccgataaggacgccgacactgcggctctcgattacgctgccgaccgcgccggcttggaatccggcatgatgttcgacggcttcgtggccatcgtggatcccctgcgcgaggatgtgcccggtgccgtggagcgctgccgcaaggcgggcatcgagctcaagatgctcaccggcgacaacatcgtgaccgccacggccatcgccaacgaactcggcattctggacgagcggcatatcgccgtcgaggcgcgccagatcgaggaaatgagcgacgaggaactgtcccgcgaaatcggccgcatccgcgtgatcgcccgcagcacgccggttatcaagatgcgcgtggtgaacgctctgaaagcccagggcaatgtggtggcggtgaccggcgacggcatcaacgacgcgcccgccatcaagaacgcggacgtgggcatcgccatgggcatcgccggcaccgaggtgtccaaggaagccagcgatatcgtgatgctggacgattcctttgccaccattgtcaaggccgtgcactggggccgtggcatttacgagaatttccagcgattcatccagttccagctcaccgtgaacctgtcttcggtggtcgtggtactcgcctcgctgttcagtggtctggccgcgccgttcaccgcattgcagctgctgtgggtcaacatcatcatggatggcccgcccgcgctgacgctcggtatggagccgattcgcgacaatcttatggaccgcaggcccacccgccgtgacgccggcatcgtctcgcgcggcatgctggagcgcatcatcgtctccggcgcgttcatcgccgtggtgttcatggcgcaaagctggacgaacttcatgggcggcaccgccgaacagcagtcgaccattctgttcacgctgttcgtggtattccagctgttcaacgccttcaacagccgcgagctgggcaacgccagcctgttcgccaatctgctgcgcaataaggtgatgatcggcgtgttcgcgctgatgttcgcacttcaggtgctagtggtgcaattcggcggcgcgatgttccgcaccgtgccgctgccgatcgacatgtggctgaaaatcatcgcggtcggtttcggcgtggtggtgctgcaggaagttatcaagaccgtcaagcgcgcagccgccgccatccgcgcgcgccgcacggccaatgaaagcgattcccagcaaccgcaccagccaatcgctctggatctggtggactgataacacaccgataacggaaagagaccgacagattcctgtcggtctcttttcattcgcggtcggacagatgcgcggctagagttctttggctcggtagatgcggatggctataagcatggagccaaaatatgcgagcagacacaacacggcgagaacaagcgccgtatgccaccagatcgtcaggaaatcggtaatattcagcaaaagccattgccagtcaacaggcaatcgggacagcagcgcaatgacggcatacaagccaaccaggaccacgccagaggccaccatcatcttgcggaaggtgaaccggtatgcacaggccagcagcaccgacccaagaatgacagccaaagcgaagatgaaagcacctgctgccaaggtaccggtccaccccatatctgctatatcgccaaagacaatgaagacgccgccgcatatcaccacgtccaaagcccagagcaggccaaccaccaacagaaaaaggtaccgacctacaacttgtgcagtgcgtgaaacaggaatcagccctcgcatggcactgtgccctgcagattcctcggatgacgcaggccccaatgcactcatacatgccatcgccgatgccaaacctccgagtccgcccatcagaccactggcaacgtgttcatcgacgtgggtcggtatcgtcaccagcgataccacgatagacagcaccgggaaaaccagcagaaataccatattcgccacgctaaacagacccgtcccgacacaatcgaatcgacattgctttactacggatttccagctcatcgtcaccattcccttgaagcaaatatgcgagaggcaattacatacgagattccatatgccacaaccgtcgttgccaataccgcaataaccagccacaatcgttgcgcgatgatggcattcgcggcatgggccaatcctctggtcaccgaagcaggcgaaatagatagcagtatggatacagccaatacaacgacatagatcaccatcatcgtgacttgaagaccgcctagtttggtccacagataacccgtgggcacgataagcgcgatcatcagcgcggtgcagaaacctcccaacggcgccgcccacagattgcccgcgaatgaccaatccggattgaccagcacttgcaacccgtcaatcagcacgatcatcgctatcgacaatacggaaatcaccaatccaaccacatatcgcgcggccacctgactcttcctcgaagccggaataatgccacgaagtcgatatccgttctgtaagtcagcaaccgccatggttagcacccacatggcgcaggtgaataccgtcatgatgacacccatgcgatagccgaagccatcaccataagcttcaccttgaaagatgacggagaacaacggtgccaacaacaacgagaacacagtccgttcgccgacgcacaggtaggccatatcgacgcgcaatgcagtggtcaatgcatgttgccgagaccgcgacaccctcagtattgcctccatggccgctcacctcccgctcaagtcacgattggaatcatgggcattggtcagtcgaatgatgtcatcaatggaagccgattcaacgacaagccccgaaaccaccgacgcaacagcatcaagcctgtctgaccggaccagcgcatcgaatccggtggcatacgtatgtgagcccagcactacgtccgcaggcagttgtgccagttcgtctggaccgcccttaatcaggcggaacgattcctcaaactcgtctttcggaccggtgtagtagagacggccatcggtgatgtaggtaatgaagtcagcagcacgttcgaggtcggcagtgatatgggtgctgaacagtaccgaatgctcgccatcctcaatgtaggcatgcaggatatccatgagttcgtcgcgggcaagcacatcgagtccgctggtcggctcgtcgagaatcagcagcttggcatcatgactcaatgcgatggccagcatcagcttcatctgcatgccgcgggaaagatccttgatatgtttcttgccgttctgtgcgtcaccaaggccaaaagtatccagatacttgtgatagcatccaccgtcccatgatggatacagtggcgcaacgatacgttcaatgttcttgacttgccactgttcatgcatgtagctgaagtcgaacaccacgccgagttgttctttgacgggctcctcgttggcgatgttgtcgaggccgagcacgtgaatcgaaccggcgtcgcggtggatcatgttgaggatgagtttgatgagggtggatttgccggcgccgttcgggccgatcagtcccatgatgtagcccttgggcaggtcgaaggtcacgtcgtccagcgtgaagccggaatcatagtgtttggtgacgtcggtgacctgcaacgccatcgcgtcggattcggatatggcggtcatgtccatggtcctttcttgaggttattccttgcggtattcctcttcgagcatgcggtccaatgcgttcagcggaatgccggcggctttggcgccccggcttgcctcggccaggctttcacgaatccgggtttcgagctgacgttgcatcagttcgttgcccttgtccatcacgaaagtgcctttgccttgaatgttctgcaccacgccctcatcggccagttcgttgtacgccctggtgacggtgagtacggagatgcgcagctccttggcgagtttcctcaaggaaggcagggcctcgcccgccttcaactcgccactgagcaccgccgaatggatttgggttttgatttgctcgtagatgggttcaccggacacggatgagatgatcagtttcacctatgcccctttcgattgtggttgactagcaccccagctgtttagctgttatacaacacagtataactgttctgcttaactgtcaaggtgtgttacataacagttgaacagtgagcaaatacatcgtcaacttatagtgtcgaaacatgactcgtgcctacaatggcctcggaaaggggtacccatgcccaacaacgccccgccgacagccccgccagcgggggtgtaacttttttatcacagcacgcgcggagcgtcgtggaagtcgaagaggacaccgtcggccaggtggcagatctcgggccaatcggaggcggaggagtcgtcgtgcatggcccagaccttcatgccgaccgatttggccgacttcatgccgaccagcaggtcttcgaacaccgtgcagtcgaccggcgcggcgcctaggcgcttggcggcgagcagatagacgtcgggctggtccttgccgacgtcgttcgcgtcatcgacggagacgatatcgttgaacagatcgaacatgccgacgtggcgtagcgccggctcacgcagatgcgggggcagcgaggtggcgacacccagtttgacaccggaggctttcagatcgcgcagatagtcaagcgcgccgggtttggcttcgaccgtggtggaataggcgacgctggccatgtcgtcccattcctgcatgagctcttcgggcgtgtctgtaaggccgaagcgtgcgatggtgtattcggcgatctggcggaattgcatggcggagactttggtcatgtagtcgggcggcacttcgattccgcgcttgttcaggaagtcgatgtcgacttggtcccagactcccatggagtctaggagggtgccatcgaggtcgaatatggcggctttggtcataggacactttccttcaacagttctcgggcgtggtctagtgaggcttcggattcgctgccggagagcatgcgggcgatttcgtggacgcgggtttcgccgttgacttcggcgatggtggtgaccacgcccaaatcgtcgtcatcggcatccggcggctccttggtgaccacgaactgcgcgtccgcccacgaggcgacctgcgccaagtgggtgacgacgatgacctgcgcgctgcgggccagccgtgccagacgtttgcccagttcgaccgcggccttgccacccacgccggcgtcaacctcgtcgaagatgaaggtctggtcggcaccgccgcgcgtgtcggcggccaccagctccaaggccagcatcagtcggctcagttcaccgcccgaagcgcttttgcccatcggcaactgcggcgacccctcgaacggcgtaaacaggaacgcgatatcgtcgcgaccatacgggccgagcggatcatcggccttgtctcgcggcgtgacgcgcacttccaaggaggcgcccagcatggcgagcgagccgagttcttcagtgacgcgcgcacccaagtcggcagcggcagccacgcgcgcggcgctcagcacgtcggcggcggcgagggccgcatcgtactgcgtctgccgttcggattcgagttcggcgaccttttccggcgaggcatccagatcctccagatcgaacgccgccttgtcccgccaagcgagcacgtcggccaaggtggggccccaccgacgggcgaggtcgccaagctcgtggatacggccgttgatctggtccagatcctccacgctgccttcgtcgcccagctcctggctcagggcgaacaccacgtcgcccaaatcggcattgatggattcaagccgatcggcctgctcggagaacgtgccgccgacgcgaatcgcgcgcaacgaggtcaccgcatgattgatgagttccacggccgaagcgccgtcggcggcgtccacatccacctgcgaggcatccagcgcgcccagcgccgaacccacgccttgggcgatgtcggccgcgttttcgatgcgttcgcggcgcgccttcagctcctcatcctcccccggctgcgggtcgattcggttgatgcggtcgatggattcgcgcaggtagtcggcctgttggcgggcagaggattcctgcgagcgcaggcgttccagccgctcatccatggcggccagcgcatcccacgccttgcggtaggcggccagttcggcttcgtctccggccacccggtccagaaactcgcgttgccgtgaggaggccgcgattttcagctgatcggtctggccatgaatggtaaccagttcgccggcgatggcccccagcaccgaacgcggtacggacttgccgccgagcacagcccgcgaacgtccggaagcgcgtacggtgcgggaaaggaacagttcgccgtcttcggggtcgacgcccgcgtcatgggccttggccacggccgcggcagcaccggtgaacccactgtcggcatcgccagaaccggcatcgttggtgtcgccggaatgttcagatgcgacggcatcatccgagagcgcgaaaatcgcctgggcccaagcctcgtccgccccggccgagacgcgcgaggattcggcggccccgccggagaccagtcggatcgcggagagcagcatggatttgccggcaccggtctcaccggtgatggcggtcatgcctgcggccggcgcaatggcggcttctcgaatcggccccagattgcggatatcgagttcttcgagcatcaggatcctgccttgccgtcacgttcgcccggcttgtcgggctcggtaccagcgacgccagcgtcaccggcaacggcaacgccagccgcatacgcggccgccgggaacgtgtgcccgtgatgcagcgactggctcgaggcctcgttgcgcgcgtgctcgcgccaaccgaccacgggcagatcgaacttggagaccagacggttggtgaacggcacgccggagagtcgggcgaggcgcaaggtatcgcgcgattcgcgcaccatgacgcgcgtaccctgcggcagggcgcgctgacggcgtccatcgcagcaaatccagccttcggacatggaatcgtccagaatatcgatggtgaaggtcgagccggagccgatgatcagcggcctggcgaacagggcgtgcgcggccaacggaatcaactgcagggccttgacgttcggccacatgaccggaccgcccgcggagaaggcgtaggcggtggaaccggtgggcgtggagacgatgacgccgtccgcgccgaacgagttcatctccacatcgtccacgcggatggacagttcgaccatcttgccccggtcggcgcgttccagtgtgatgtcgttcagcgcccaatcctcaatgggcttggtggcgccgggcagccagacgtccacatgggcgatcatgcgttcgtcgatcgaatagtcgtgggtggagacccggcggatcgcctcgtcgatctggaagctttcgaattcggccaagaagccgacatgccccatgttcacgccgagaatcggcacttgggtgcagtggacgagttcggcggcgcgcagtatcgtgccgtcgccgcccaggaccacgacgatttcggtgtcgtccgacacgcacggcggctgcacgccgaaatcgggggcctcggtgttgtcgatgatggcgacttcgaaaccggccactcgcagctggctcaccgcctcggccactacggttccggtctgcctgagcctggtatgcgtcaccaccaccgcgttgcgcttggccatggcatcctcctgtcgattcggtcgcactgctcattattctaaccgcagacaccgtcatcagtcgtacaggtgttcgaaaaatgctgcttcgtggcgcgtcgccggcaacgttccacagagtcgattatcgtaaggcttcggcatacaatggcgtacagccgcgcaatcaccgtacgcgtgccgtgcgcagcgcgatggcatgccgtatgaccgtacagcagtatcagttgaggagcttgaggacccatggccaatgacttcgacgaatcctccgccaatgaggaggcctcgaagggactgtcatggtggtattcagccgatgtactgagccgagacaaaagcgataaaaccgccaagcgcattcgacgtatcagcatcaccgaccgtctgctcaggcacccgggccgtctgtccatggtgtatttcggcgcactgatcatcatcgtcaccggtttgctgctgctgccgatctccacatcggacatcatcttcaccaatttcccgatcgcgttcttcaccgccgtctcggccctgtccacctgcggcattccggtggtgaacaccggcgaatactggtcgatgttcggccaggtcgtcgtcctgttctccatccagttcggcggtctgggagtcatgaccttcgcctcgatggtggctcttggcgtttcccgcagactcaaggtctcccagcgtatgctcaccgcgaacgagctgggcaccacgaagctttccgaggtcaaaggcgtgctcaccgtggtgctgggcacctccatcatcgccgaggtgctgaccttcgtgctgctgctgcccgacctgttccgcgtgaaccatggcaatatggggcgtaccttgtggcaggcgctgttctacgcggtgtcggcctataacaacaccggtttcacgccggatgccactggtctgcatgtgaaccgttggggcgtggggctgccgattctcatcagtgcattcatcggaacgctcggcttccccgtggtgctgaatctggtgcagtgcgcacgccggcggctcagcccgaaacgttggacattgcacaccaaactcactttggtgaccaccgctgtgctggtggccacctcactggcttggttcctgctggtcgagtggagcaataccggcctgttccccgcagatgaccccggcatgaagatgcgccgtgcgatgagcgccgccgtcatgccccgctccgccggtttcgatatttcctgggtgcccgaagtcacgaatgagaccaaggtgttcatgagcatactcatgttcatcggcgcaggttcctcatccaccgctggcggcatccgtgtcaccacgttcgcggtgattctcttgatttgccgcgccgcattcaccggccatcgcgatgtcaccgtgttccgccgccgtatcccccgccgtattcagatgaccgccgtgtccgtgaccacggcctgctttgcgttggttatggtcggtgcgatgatgctgatgttcaccaccggctgcgcgttcgtggacgccgtgttcgaagcctgctcggccttctcgttgggtggttattcggtgggcgtggcaagcgccggcaatccggccagcctgtttattctgtccgccgagatgattgtcggacgacttggcccgttgaccatcgcctactccatcagccgaccgatggctcccgaacctattcgttatccgcaggaaaacattatcgttggctgatcggccattcaatcggcgcccagcaatctgacatagagaggaccatcatcatggcagcaaaaccgagcggcaacaaaagcgtgctggtcatcggactgggccgtttcggcgggtccgtggccgccaccctcgaccagatgggtcaggatgtgctcgcagtggacaagaacccggagcttgtggcccgttggtccgcgcatctgcccaccattcaggccgatatgaccgatgtgctggccatcgagcagatcgacgcctcccagttcgacacggccgtcgtggccatcggcgacagcatcgaggcttcggtgatcatcaccggcaacctgctggacgccggcgtttccgacctgtgggccaagtccgtgtcccaggagcatgcgcgcattctgcagcgcatcggcgcccgccacatcatcaacgcggagaccgatgccggcaagcgcgtgggccatctggtggccggcaattatctggattacatcgaaatcgacgggccgtacaccgtcgtcaaggtccacacgcccctgtacgcggtaggccgcagcatcgaggacgtacaagtacatgacaagtacggcgtgaccgtggtgggcctcaaggccccaggcaaggagttccagtacggctccaaggaactggtcatgcatcgcaacgacgaactcatcctcatgggcaagcaggatcagatcgaccacttcatccaaggctaaccccctaactgcgctcgctataccccctatctgctcacatcgtgaccgatataaccccctcaacatggatgcgctcattattgtggcaataagccataaagctgtacgtccatattaataaggggagttttatcatcatgggcaagcatacgcagaattgcacgctgataggcaaaggagtctacggcaccataggagtggaccaacgttcccgtcttgccgatggcgcgcattttcacaccatgattgtgaccagcaccctcgaggcctcagttatagaaggggacaaactggtcatcaaaagtggcatcgtgcggtgtgatggtgatattcgcgtatccagcatcagcggcagcggcgacatcgaagtcggcggcgacattatttgcgatgagataacctttaccggcaaactacgatgcaacggcgatatcgtttgttccggaaatctgtccgtcaatggctccctaggcacccgtcatattagcggtcagacagtccgcttgaacggcgtgttgaagggtcatgacgtcaacagcagggctctggaagttcatccactccgcagtacgatgttttctcgttttgatatggatgggtatgaggatggcagcacggttcgccatatcacagccgtcacggttgaagccaaccatctgcaatgccggactttgacagcggactccgccatgctacgcaacggcagtgcggtggaaagcgccacgtgtgccaccgcactaggcgtcgaccgtacctccagcgtgctgctggtgaacggagactgccaacgcattcatctcaagacagcgtaaagcaggtattcctcattaccgtgggtgccgatgatgggactatcggcagtggccaccacgtcaagtccgtgctgttcagcacaggcgaccacgtcgtgtaatgcccgctcccgcaatgccggatcttcaacgatgccgtttttgccgagtcctgcccggccgacctcgaactgcggtttgaccagtaacacaatctgcgcaccgggagccgcgatgcgcgcgattaccggaatcacataggtcagggaaataaaggagacatcggagacgatcatcgccggccggtaaggcaggtcgtcggcctctacttcgcgaatgttgacgccgctcatttcgatgacgtgctcgtcattggcgatgcgcgggtcgagctggccgtgcccaacgtcgagcgctacgactttggccgctcccccgcgcaacagtacgtcggtgaagccaccggtggaggcaccgatatccagacattccaagccttccggcccggtaaggccattgccggcaaaggtttcgaacgcgcccaagagtttgtaagcgcctcgggagacgtagtcgtcgcccttatccacggcgagttcgctgtgcccggctttgaccatgaacgatggcttggtgatggtctcgccgtccacgcgcacatgcccggccttgatgagtcgctgcgctttggcccgcgattcgaccagtcccgaagccacgagcatcatgtcaagtcggtcaagtggagtcgcgggatcgatatgctgctcggtcatatatcttcctttcggcccaccatccaccaacggggtggctcggcatggagccaccatccagcacttcacgtcatcttccgctggcgggagaatgaatcacctctgctagctgcggctgttatcaagctcgtgttgtaaggattccagcacgttgcgataggtctcaagcttgcggtcgttgtcttgttcatcaatatccgcaagttcggggtatcgctcggtgaccggcgcatgttcgctatccgtaggcataggactatgcctcgatggcgaacaccggtaccgtggcctcgctgagctgtgcgccttggtcggcggcttcccatgcggcgcatacggcggcacgcaggccgtccatactggtggggtcgctgacgtgtacctggccgttttcaaaccaagcgctagccttgcggcattcccaagtaccgctctcgtcgcggaccggctccggttgggcttcgccgagttcacgtagatcaagggcgatgaatgtgggcctcaggtgtgccggagccagcatcagttcggtcgggttggtgacaccggtcagcaccgccagcgaatcatagtcaccgcggttaccggcctcgatatcggtgtcgagtcggtcgccaatggcgatggacgcctccttgggcaccagatcgtggccttcggcggcgttcagttcgcgggcctcatcgtacatgtacgcttccggcttgccagcggaggcgaccggttcgacgccagtggccgtgatcacggcgcgaatcatcgatccgcaaccgggggcgatgcccagttcacgaggaatcgtcaggtcgcggttggtcacgaaatacgtggctccggcctcgaccgcgaacgcggcatcggccatcatctgccaagtcatatccggataccagccctgaataacggcctgcgggcggtcctgaggaccgtccacgatggtcaggccgttgcgggtgacctcatcgcgcaaatgctctgcgcccaatacctgtacgcgcgcgccggcgggcaacgccttggccaccacacgggcggccaccaccgaagaggtgatgacctgccacggctccacgtccaagccgaagcccttgagctggtcggctaccacgtgctggaagcgcgaggagttgttcgtggtgtattcgatggtcatgccggcggcttcggccgcacgaatggaatcggctgcgtattcgaccggattcttgccgcgatacaccacgccgtcgaggtccagcagcgcaagctgataggcctcggcgagcgggcgatcggtgcctttgaggaaacgggtcattacgccgctcactcctcggtttcggtttcggtttcgggttcggtggagtcggagtcggcggattcggcggaatcgtcagcctcggcgtcattggcggaatcggtctcggtctcgtcggcctcatcagactcggcatcaccgtcttcagcctcgtcatcctcatcgccgtattcctgctccggatccggggcgtactgcgcctcatccggatcgatgccgagcttttcgagcacgtcggagtcgtcggtgatgtcttcgagatcgtgatcgatcaccacgtcgtcgctgttttcgtcaatctcctcgtcggcatactggtcctcaagacggtccagcaggtcgttgagctgctcggcttccttgctgcggccgacctcttcaaggaagtactgctcggcctgcacggcacgcatgcggtactcacccggcagcccctgggaacggccgacggtgtgaaccacttcaatggccttgtcccacatctccaaatcgccaagggcaccggcgtacaccaggaacatctcgaccttgggagcgccatgcagctgcttgccctcatcggacagcgccagttccacggccttcttcggctctccgacgccacgctcgcagtcagcgatgaacggcaggtagtcgaggaagccgttcatacggtaggcggtgcggaactcacgcagggccagcttgtagtcgccctgacggtaggccacgaacgcaagcgtctcgcgggcgaagtcgatgcgggaggcctgacgggccacccacttggcgtgctccaaggcaagttcggggtcgctctcctccagcgcgaaagcggcgaggatgtgcagaccaatgttctccgcgtgctccttggacaggccgcgcagacgttcgcgctcatccttggacagcatcgaccattccatgcccttgggcatcttgggctcgtcgggacgacggtcggtgtacgggttctgcgaggggaagctcatcgtgccgtcggagttacggcgcgggcgcctcatgtattcagagcgcttctcctcacggtactggcgcttctcttcctgcgaaaactcgcggaattcgccgtcacgacggttgttgtcgcggcgatcgtcacggcggaagtcacgacgatcatcgcggcggtcgtccctgcggaagttgcggcggtcgccatcacggcgatcgtcgtcgcgacggaagttgcgacgctcaccatcgcggcggaaatcacgacgatcgttatccctgcggtcatcgcgacggaagtcacgacggtcattgtcacgacggaagtcacgacggtccccatcgcgacggtcgtccctacggaaatctcggcggtcgtcgttgcggcggaagctgcgacgctcaccatcgcggcggaaatcacgacgatcgttatcacggtgctggtagcgcggattctcgccgttctcgccttcgtgggaacggtagccgccttcgcggcgcggcttgaagccttcgccgtcacggcgcggaccattgccgcggtaaccgcccttgccgccgaagccggagcggccgcccttgtggaagccgccggacttgccgtacgacttgcggtagccgccgtggccctcgccatcaccgtcacggcgcggcgcgtagccctcgccatcctcacggcgacgcggcttgaaaccctcaccatcatgacgcggcttgaaaccgcccttgccgcgcggcttgaaacccttgccgccgcggttgcccggtcggcgatcgccataccccttatggccgccgccgtaagacttgccggaacgctcgttaccttctgccattacttgttttccttaattcgttgttgattaacggttttccacggcgccgagcgccttcttgccacgacggataagcgcgaagcggcctgccaggaagtcggcttcggccagcacctgatcctcatcctcgatacggttgttgttgagatacacgccaccggacttgatggcgcggcgtgcctcggaagcggacttgaacagtccggcagcctgggcggcgtcgattacgcgatcgccgggcttggagacggggaagacgtgctcgccgttctcgtcgaccaccttgaaaccgtcgagcacggattccagcgtttcctcgtcgatgtcttcgaggttgccaccgcggccgaacagcgcaccggaagcatcgatggcagcctgggtagcggcctcgccatgcacgaagctggtgacctcccaggcaagggtcttctgggcctcgcgcttgccggggttggtcttggattcctcgaccagtcgttcgatttcggccttgggcaggaaggtgaacgccttcagcaggctttccatctccacgtccgggcggttgatccagaactggtagaacttgtacgggctgagcatcgtggcgtcgagccagacggcgttgccctcggacttgccgaacttcttgccggaagcatcggtgataatcgggctggtgaacacgttgacgtccacaccgcgcaccttgtggatcaggtccaggccggaggtgaggttgccccactggtcggagccgccgagttccagcgtgcagtggtattcgtcaaacaggtggaggaagtcgttgccctgcagcacctggtagctgaactcggtgaaggagatgccttcctcagagttcaggcggcgggcgaccgtgtccttggcgagcatggtgcccagacggaagttcttgccgacgtcacgcaggaagtcgatgacggtcatcgaggcggtccaatcgtaattggacacgaaacgtacggcgttcgcgccttcggtgtccagaatgccgccgatctggttcttcaggcgatcggcccagccggccaccacgtccttcgggttaagcgtacgttcgccggactggcgcgggtcgccgatgagtccggtggcgccaccgaccaaagcgatcggatgatggcccgcaagctgcaggtgacgcatgttgatgagctgcacgaggttgccgatgtgcaacgatgcagcggtgggatcgaagccgcaataataggtgatgggctcgccgttcagtgcttctgcgagtcgatcccggtccgtggactgggaaatcaacccgcgccattccagttcctcaagcagggtgttgaaacccgcttccttgaagtcggtgacgtgagccatagcttgtcgcttctccctatcgaattgtgaatgagactgcccaattgggcacagtcaagtttcgcagaacatggcgacagtgccgaacaccagccgagccgcgcgattcagtaaaacgccttattctagcggcgcgggcccataagttcgcgcaaagagtcgatgatgtcctgacgatccggcacctggaacttcgggaaggacttgagcatacgcttctgctgtgcgttgatgacgccattgacggcccagcgcagacgctcaaccgtatcctgcgaaagctcacgcatcctgtcggataccgcactggagccccactgccacgtgccaccggcgcgtgccgccacatcctgtaccacctgagagacggaatcgagcacctgctcgaattcgagcatgcccgtaaccgtgaccgccaagtcgatgatggtgatcagggccagtaccgtgaccagcgtatgcagcatcggcagcggaatcatatccgtgacccgctcgacatatggctgcgaaccaagtaccacgcccacgccgccgaggccgaaaatcaacgcgcccagcaggcagacgcggccttggaggttgaagcggaagttcgagtaatcccaccagcgggcgtggaacagctgctccatgacccacgaggttgtgtattcgagtatcgtggcgcccaccatcgaaatcaggaagatgatgatcgggttatgtacgttgccgagaatggcgacgccgagtatcgcgccggtgccgtagatcgggcacagcgggccgttgaggaaccctcggttgaccaagcggtgctgttggcaggagacgagaatggactcgtacatccagccgacgaaactgtagaacagaaaccagaggaaataatgttcgagtgtgatgatcatcgacgggcttcgatctcggcgtaaggcttcgcggcgggcaacgcgcgcttgttgaaccggtcgaacgagaaggtctcggcggtggcggagcatttgtccgccaaggtgaccagatagccttcgatatagcgcggcggcaccggggtcatcgggaacatgtggttctcgatgctgttgcgttcgatatcgttgagcttgaagtccttcagggcattgaccagggcggcgtggccatgggtgaagccatgccactggtgttcgccgttatcccagtcgtgccagtcgtacaggaagtaatcgtgcaggagggccgcgcgaatcagggatttgaggtcgacgcggtaccacaggtgtgcgcggtcggccatccacacagccaggcaggcgacacgcacggaatgttcgaacgtggtgacattgccgtgctggtagcagcagcgttcgatctgcatgtggcgatgctcgatgacctcacggccgtgcttggcgaccaggcgttgaatctgcgttcgggtgagcagatgtcccacgattttcggtccttcccgttttgggttggttcagtgcaatcccctgttgtgaattacgattacccggcgatattcaagaatccatcgagtaataccgtgaccgattgtagggcacaaatatgtccgtgcacactcatccaaaagaacgacaacgggaaccgttaatcgtggtgggtttcaagatagtcgagataaccttgaaaaccgccatcgaggcttgctacatcgtagccgcgatcggcaaggatttcagctacttcctcgctccaccatccttgagcacaatagactacgacagttcgatctgtgggcacggttttgagcacatgggccagagggtcgagtggtgcattgatggcaccttcgaccgggtgggcggcgaagtcggctggttccctcaagtcgagcagcgtgaccgtattcgggtcgagcttggcaaattccgccggcgtgatgcggcggtacgatgcttcactgctctcatcgtcatcgaccgcattatgcaaagcaataggcatgttcttcccctctcgttctgatcttggcacccctcaaggaggggcaccacatagctctaaatcgcgcaggccggctgaatatagttggccggatcaatagcagtaatggtcggctgctcaccgcacatcgggcaatccggcacatgctttggcagtgggacccgtcgaatattcatggtcagggcatccacagtgagcatgcgagccacgagcggctcccccacgccggcaatcagcttgacggcctcagtcgcctccagactgccgatcacgccgaccaccgcgcccagtacgccggcttccttgcaggtcggaatctcaccggcggcgggcaggtcgcggaagatgcagcggtagcaggggccttcgccgggaatgacggtcatcacctgaccggcgaatccgaccacgccggcatggatatacggcttgccggccagcacgcaggcgtcattgatgaggaattttgcggcgaagttgtcggtggcatcgatcaccagatcgtacggttcgatgaggccggcgatgttgctcgcgtcgacgagctcgtagtaggtatcaaccgtcacatccgggttgagcgcgcggatggctgtggccgcggattccactttgggcgctccgacacgtgcagtggtatggatgatttggcgttgcagattgctcatatccaccacatcgccgtccaccagtccgatatggccgacgccggccgccgccagatacagggcggccggagaaccaagaccgcccgctccgatgatgagcacgctggaggccagcaaccgcttttgccctttgacccccacacccttcaaaatcagatggcgcgcgtaccgctccacctgttcatcagtcaatgccatgttttctccatgtttccatctcccctcagtccgctacgcggccagctcccctcagagaggggagctaataaaagtgtcagtgcaaataccccgtagtcgggctggacggcacagcctgtccctcggtcactttgccaaggccagacaaatacgccgcacgaccagcatcgatggcgtgcttgaacgcctcagccatcagcgggatattgccagcagaggcaacggccgtgtacgccatcaccgcatccgcacccatctccatcgcatcgcaggcctggctcggacggccgataccagcgtcgatgatgaccggcacatgcgcgttggcgatgatgatttcgatgaagtcacgcatgcgcaggcccatattggagccgatcaacgaaccgagcggcataacggcagcggcaccggcctcctccagctgacgggccgcaatcgggtccgggaacatgtagggcatgaccacgaagccttccttggccagcatttcggtggctcggatggtttcggcgttgtccggcaagaggtacttggtctcgtgttcgatttcgaccttgacgaagtcggtgtggcacacttcgcgtgccagtcgggcgatacgcacggcttcctcggcgttgcgcgcaccggaggtgttgggcagcagcgtaatgccttcgggaatgtagtcgagcacgctgttctcggtggtctgcgcgcggcgcagtgccatggtgacgatttgcgtgcctgcatgttcgaccgtagccttgatgaggttcaggtcgtagcggccggagcccagaatgaatcgcgactggaactcgtgaccgcccaggttcagcggcttgtcttccaccgggagaatcggcgcggcggtgccgaccggattggtgacggcgggctgcggcggcagcggagtcgcctcaacagatgcttcagtaaccggattaatattgctcatagcttttcctttcatccaccctgtacaaactgcacaatttccatgacgcactggtcgtcgagcatggcgtcggcacgcttatcgcgcgggataatctcaccattgagttcgatggccacacgctcggcgcggaatccgtgcgcttcgagataatcggcgacgctgaccggcgtctcgagcgtgacctgctctccgttgacctgcataatatcctttcagatagtaaaaaagggtgcacgaaacgaaccgtaccttaagtggtgcgcccattcatgaacccaatcatgcgaccgttcgaccgctgtgatgtattggctccatcacgaccgtctcacggctgaattatgcaaacggaatgaaagctgtatcggagaacccggcaaatctgcgacaacgattccttacggcggcatgacccgcgtcaagttccccggtcgaagtctggcgacttcctctcagcctcacggctcccgttcgttacggtttctcagtgtatgccgttgcagtgacaacaacaaaatagagctccctcatcagagggagcttcattgggactagaacgtgccgggggctttgtaggcggagccatccgacgtggatgcggggaagagcttgagttcttcgacctcggccttggcgtcggcgatctgctcgcgcacgcgaccgtaagcggtgccgcccttgccgttgcgggagtcgaccgaaccgtggctggagagcacttcgcgtactcccggagccttgtcggccggcaggaacgcggcgaaggtctcgatgaagtcattgtcggtcagatcccacagttcctggccgcggccttcggcgagcttgacgcaggcaccagagagctcgtgcgcgtggcggaacggcaccccgttcttgacgagccattcggcgatgtcggtggccagcgcgaagccggtcggagcttcctcttccaggcggtcgccgtcgaagtgcatggtcctgaccatgccggtgaaggcgggcagcagcacttcgagcgtatcgacctggtcgaacacggcctccttgtcttcctgcagatcgcgagcgtaggcggtgggcaggcccttcagggtggccagcaggccggtcagatcgccgatgagtcggccggacttgccgcgggcgagctcggcgatatccgggttcttcttctgcggcatgatggaggagccggtggaatagccgtcgtcgagcttgacgaaggcgaactcctgggtgttccagatgatgatctcctcggacaggcgggagatgtccacgccggtcatggcggccacgaacgcgaattcggccacgagatcacgtgcggcggtgccatcgatggagttgtcggtcacgcgggagaagccgagctcacgcgccacggcctccgggtcgaggccgagcgtgttgccggccagtgcgccggagccgtacggggaggcgttgatgcgcttgtcccagtcgatcagtcgctgcacgtcgcgaatcagcggccaagcgtgggccatgagctggtgcgcgagcagcacgggctgggcgtgctgcatgtgggtgcggcccggcatcacggtgcggccggccttttcgctctgctcgatcagggcgttgacgaggtcaagcaggagtccggcgattacgcgggagtgacggcgcaaccacatgcgaatcaggcaggcgatctggtcgttgcgggaacggccggccctgagcttgccgccgagttcatcgccggcaatgtcaatcagaccgcgttcgagggcggtggcctcgtcctcatcgtcttcgatgggggcgaaggagccatcgtcaacgtggcgctggagcgtgtcgagcgcatcctccatgcgctgcagctcgtcggcggtcagaagtcccgcacggccgagagcacgggcgtgggcgcgggaaccggcgatgtcgtcgtcggccaagcgccagtcgaactgcgtggacttggacagtcgggccaattccggcgacggaccagacgtaaagcgaccaccccacagggccagatgttcgttgttctcagtcatgaaggctccttgaaaccatggattgcaaacaaatcagactgcttgtcagactatcagcgttgggctacataccggtggattcaagttgttcgtattccatggcggcaatgtcagggatactggtcacgtcgtattgatgaaaagaaccgcatcgtataccgcattacgggtaacgatgttcaaaacctggaaatagccgtctgccgaactcattacggagagcactgagcttcttccgtcatcggcaaaaaaacgaggggagcacgagcataatctttgctcgtactcccctcagtcatctgcggcgacagcgtcctgtaattacggacagcctgacggctgctgattgttggctcactgtcgttcgcacctcacctgcaaacagcccactgggctgtttgctttacggcgcggcccctcaacgaggggagccaaagtaaatgattactcgacggtgttctccgggacctcgatgccgttgccgaacttgacgtcgcgcgctgcggccacgcgggacggcaggccgtagatgtcgatgaagccgttggaggacttctggtcgaaggtatcgccggaatcataggtggcgagcttatagtcgtacagcgaggagtcggaacgacggccggtcacgacggcgcgaccgccgtgcaggaccatgcgaatctcaccggacacgtacttctgggtgtcctcgatgaacgcgttgagcgactgagtcgccggggagaaccactgcgcatcgtagaccaactcgccccagcgcttgtcgatgtcgcgcttgatgcggtgctgttcgcgttcgaggcagcagttctcaagctcctgatgagcggtaatcagggccacggcacccggggcctcgtacagctcgcgggacttgatgccgaccaggcggtcctcgatgaggtcgatgcggccgacgccctgggctccggcgcggcggttcatctcttcgatggcctgcagcggagtgacgtcacgtccgtcgatcttgaccggcacgccttccttgaactcgatgacgacttcatcttcgaccggcgggaaggccgggtcgtcggtgtaggagtagcagtccttggtcgggccgttccacggatcctcaaggaagccggtctcaatggcgcggccccacacgttctggtcgatggagtacggggacttctcggtctgggtgatcggcagcttgtgctccttggcgaacgcaatctcgacgtcgcgggtcagggacaggtcgcgaatcgggctgatggccttcagcgtcgggtcgatggaggcaatggagacctcgaaacgaacctggtcgttacccttgccggtgcaaccgtgggagatggtgtcggcaccgaactggtgggcggcgcgcacgaggtgcttggagatcagcggacgggagatggcggagaccagcgggtagacgccttcgtacatggcgttggccttgagggccttcatgcaatattcgttggcgaactcgtcacgggcgtcgaccacgtaggattcgacggctccgcaggcaagggcgcgctgcttgatggtctcgaggctttcgccgccctggccgacgtcgagggacacggccacgacgtccttgccggtgcgctccttcaggtacgagatggcgacggaggtgtcaagaccgccggagtaggccagaacaatgcgcttgttatctgccattggttccctttcgttcaaggtctgaaaaacaaactgatgcaagtatatacagaggactgtatatttatgcacggcgtgttggttatttggaagcgagacttagtagccagtcggagcgggagacggcggtgtcgtcattggtgcaaatcaccatgacggtgtcgtctccggcgatggtgcccagcacgccttcgatcggctgcttgtcaatcaccgaggccacgtattgtgcggcaccggaaggcgtgtgcaccacaaccagatttccggcggcagccaccgaggtgaccagtccgttcagcacgcgggacatctgtgcctcaccgcgctcccctacatcctcaccttctgaagcaacgacgctgcgacccaccgtgtaggccaccgtgccgtccttcagccgggtcttcaccgcatgcatctcatcaagatcgcggctcagggtcgcctgagtcaccgcaataccctcgtcgataaggattttggacagctgtgattgcgaggtgatgatatgcgtggcgagcgcctgttctatggcactcagccgcgccgccctggtggcagggcgctgcagggacggaccggtttcactcatgcgagcaggctttcgtctccacgggccttgccggtcaaccaagtcagcaacgctttctgtgcgtgcagacggttctcggcctcgtcccacaccacggactgcgggccgtcgatcacttcagcggtgacttccttgccgcggtaggcgggcaggcagtgctggaagagcgcatccggcttggccaatgccataagttcggtgttgacctggtaatcccagaacggtttggagcggatggcgtattcggcttcctcgcccatggagacccaggtgtcggtgaacacgcagtcggcgtcctgcaccgcttccttggcatcggtggtgaccaggatggagccgccggtctcggccgcgatgcgcttggcgtcggccacgatgtccgggcggggcaggtagccgtaggggccggccacgcgcacgtccatgccggccacggcaccgccgagcaggtaggagttggccatgttgttggccgcgtcaccgaggtagacgatggtctggttcttcaggttgtcgacgccgcctcggtgctcggcgatggtctggaagtcggcgagaatctggcagggatggaagtcatcggtcagggcgttgaccaccggatgggtggagtacttggccatttcttcgacgcggtcctgaccgaaggtgcgccacaccacgccgtaagccatgcggtcgagcacacgagcggtatcggccacgggctcgccacggcccagctgggagccggacttgtcgatgaccagcgggtaaccgccaagctcggcaacgccgatggagaagctggaacgggtgcgggtggagggcttgtcgaacagtacggcgacggcctgcggaccggcgaacggctgcttgtagaagcggtcgtggtggaacttgatggcaagttcgagcacctgcttctgttcctcatggttgaggtcgtcgtcacgcagcatgtggcgaagttctggggtcatgatgatctccttggatcggtggggtggcagtgacggagagaaatcagtcgtcgggcaggtccgtaggcacatccttgaggatggcaagtgcctgatccacgtcttgtgcggttataatcagcggcggtgcgaaacgcagcgcattgggagccaccgcgttgacgatgagcccgtgttcgaggcagtagttcatcaccgcgtgggagcagggatgcttgagctcgacggcgtccagcaaaccacgaccgcgtacggaaacgaacagcggattaccggtggccataatgccatcgcgcagctgttcgccgcgagcttcggcgttggccaccagattctcgtcttcaatcacgccaagagtggcgagtcccgcagccgcacccagcggattgccggcaaaggtggagccgtgggaaccaggagtgaacagagccgcaagtttctcgccgaaagcgatcatgccgcccatcgggaatccgcctgccacgcccttggcgaaagtcaccatatccggcgtcacgccgccggacagatcgtcacgctggaatgcgaaccacttgccggtacgtccgataccggtctgtacttcatcgatgatgagcagcgcgtggttgatatcgcacagttcgcgcacgaacttgacgtaatcggcgcccaacggctgcacgccggcttcgccctggataagttccagaatcacagcagccaccggccccttgccatagtggccgagaccggtctgtgcaaaagcgtcgtgcagggcgaccttgtcgccggcgcgtacgaattcaatgttcggcaccagcggatcatacggcttgcggataccgggtttccatgtggcggacagcgcacccatcgtacggccatggaagccgtgagtcattgcgagaatgcgtgcgggcttgccgccgatggaaggcagggcaccaggcaaggtgcggccatacagcttggcaagcttgagggcagcttcattgccttcagcaccggagttgccgaagtagactttggagccttcaggtgcaccagccagcttgaccagtttggatgccagctcaatttgcggctcggacgcgaaatagttgctgatatgagccaccttggcagcctgatcggcaaccgctttgacccacttggggtgggcgtatccgagggaattgacggcgatgcctgccaggaaatcgaggtattcgttaccgtcaacatcccagatgtgggcaccttggccgtgatccatgacgcgcaacggcgtaccgaacacattcatgtggacctgagagtactctcccagccacttgctgtcctccgtacctagtttttcctcatgctcagtagccataagagctcctcatttccagtccttcatcgggcataaccatggtaccgatgcctgcggaggtgaatatctcattcaaaatcgaatgcggcttgcgcccgtcgatgatatgggcttggggcacgccaccgtcgatggccctgacacaggcctccatcttgggtcgcataccggattccaggtccggcagcatatcgcgcaggttttccacaccgatccggccaatcagagaattcttgtccggccaatcggcgtacagaccatccacatcggtcaagataacaagcttgcgtgcgcccacagcggcagccaaagcagcggcggcggaatcggcgttcacgttgagcacttcagtggcatcttcttcgttcggagccacggaagagacgaccgggatacgaccggcggccaccagatcctcgactgccgaggcatcgacggaaactacatcgccgaccaagccgatatcggtgggcttgccattgatgatgggcctgcgctgcatggccgagaacaggccgccgtcttcaccggacaggcctacggccagcgggccgtgcgcgttgatcaggccgaccagttcgcgtgacaccttgccggtcaggaccatgcgcaccacgtccatggcctcgggggtggtgaccctcaggccgcctttgaattcggatttgatgccgagggccttgagcatgtgggagatctgcgggccgccgccgtgcacgacgatcggatgcaggcccacctgacgcaggaagaccatgtcttcggcgaagcactgcttcagatggtcatcgaccatggcgttgccgccgtatttaacgacgatacgctggccggcgaactcctccagccaaggcagcgcttcaataagcacttctgccttctgatcggcgcgcaaatcggtgtgcacgtcgaaatggaacccaggtcccttcaattctgtagccaatttttctcttttctgcgacgccggcgacgctatcgctgccggctgctacaaacagcccactgggctgtttgtcagctttcgtagtcggcgttgatgtggacgtattcgtgggtgaggtcgtcggtccagacggtggcctcggcgtccgagccggtgttcaggtcgatgtcgatgtggacttcgcgcggggtcatgtcgacctcgctgcggtcgcggccggcgccgccgttctcgcagatgcgcacgccgttgacgtccacggtcaccttgttcgaatcgtaaggcgcgacttcaggcggcacagtgcccaaggagctgacgatgcggccccagttcggatcgttgccggagatggcgcacttgagcaggttcgaggcggcgacggcacgaccacaggcaagtgccgcgtcctcgctggtggcaccggtgacagtgatgcgaatgtcgtgggaggcaccttcgccgtcgccgatgatctggcgggacagggagacgcaggcctcacgcaccagcttgttgaattcgtccttgtccggttcgacgccggaggcaccggaggcgagcagcaggaccgtgtcgttggtggacatgcagccatccacgtcgatgcggttgaacgaatgttcggcggccacggcgagtgcggcctgcatctggccggcggagacgaccgcatcggtggtgatgatgcacagcatggtggccagctgcggggcaatcatgcccgagcccttgaccatgccgccgatcttccagccgttggagccggtcagttcgaccgttttcggcttggtgtcggtggtcatgatggcgtgggaggcggcggcgccggcttcggcggtggcggcaagagcctcatgggcactcttggcaccagccaacacgttgtccaacggcagcagttcaccgatgagaccggtggagcagacagccacatcattcggttcggcgccgatgagcccggcgaccgtttccgcggtggcgacggactgggcgtaaccggcctcgccggtgcaggcgttggcaccgccggagttcagaatcacggccttgacgtgaccgtcggcgacgaccttacggctccactgcaccggggcggcacagaaacggttcgaggtgaacacgcctgcagccgcgtcgagcgggccgttgttgaccacgagggccaagtccttcttgccttcgacggatgaaataccagccgccacgccggcggcggagaaaccttgtgcaaatgtaacgctcacggtgctactccgatcttggtcaggcccgcgtcttccggcaggcctagtgcgatgttcagtgattggaccgcttgtccggcggtaccacggttgaggttgtcgatggcggcaaaagcgtagatgcggccggccttgcggtcggtgacgacctgcaggtgggctgcgttggatccgatgatgttgccggtggcgggcagcgtgccctcgggcagcagcaccatgaagtcctgaccttcataggccttggaccatacggcgcgaatctcctcatcgctcagtgccttggccttgtccgtcatgcgggcggacacggtggcgaggatgcctcgggacatgggggcgagaatcggcgtgaagccgagcgtgaattcgctggcttcggccgcgctcttgccggccgcgtgggcgaagttctgcagaatttcgggaatgtggcggtgcttgccgcccaccgaatacggcagggcggattgcagggcctcggcggcaagcaggttggtgcgcttgagattcttgccggcacccgagtatccgacgaccagatcggccacgatatcctgcgattcaaccagtccttcggcgatgccgggctggagggccagcgtggtggcggtgacgttgcagccagggcctgcgatgcgcttggtgccaggaagcgccgcgcgctggcgggtgtatgagccgtccgcggctttgccggtgatgagctcgggcatgccgtaggtccaatgctcatagaaatcgccgccgtagaactcatcccaagcggcctgctcttcgagacgatggtcggcgcccaaatccacaaccacggcattcggatcgagctgcgaggcgagcttgcccgaagcaccgtgcggcagtgcgaggatgataacgtcatgcccgttcagcacttcgggcgtggtatcttcgacgaccagattggccagttggggaatatgcggcatgtgcttggccatcgactcccccactgaggaatggcctgccacgcaggtgatgtcgaagtcggggtgcgcggccagaatgcgcagcgcttcaccgccggcatagcccgtggcaccggccacggccactgtatatttcgccatactcatctctttccactgatgtgtcttgggatgagtatacgcgattatgcagactattgcatatttatgcagtgggtgtgttggtatgtgaacgctacttatgcggagatggagtcggaggaggagccggtgccgccggtgagttgctggagggcttcctggtagaggctcatggcgtcatagccattgaaggccatccagatgacggcgatggtgtacagcacgttgatcaccacggcggccacagccaaaccgaagcctttcatatggaaggtgcgcgtgcgccacattgccaccgcgcccatcagtgccgagagcactggcaccgggaagaacagggcgaggataaaggagatgatcgcatacgaatcccagtgcccgtagagtggattctggtttggatcgttcaggtcgatgccgtggtaataatgcggctggtgaggctgaccgttcggctgttgaccatacgactgcccctgcatgcccgggtacccgcccggatatgcgcccggaccggactgttggccgccttgagcatacggccagccgcccgcctgctgattgccgggccacgccggctgctgaccgtacggctggccggcctgctgggattgcgccgcgccaccgttgatgccagcggctgcggcggaatccttcttagtatccggctcgggagcgccataaatatacgggttgtaattcggcccgtattggccagacatagcaccatattcaggctgctggtactgcccgtatttcggcttgtcctgctccggttggctcatgacgctcctcgattcggatgattggttgggtcaggcgcgcagctgggcaccgatttcggcggcctcagccacgatggccttgcggatggcgtcgctgtcttcggcggacagcgtcttgctcggcgaacggaacaccaccgcataggccagggacttcttgccctcgcccacctgttcgccggtgaacacgtcgaacagttcgatggattcgaggttcgagccggcggccttgcgaatcacgttctcaagctggcctgcggtcacggtctcgtccacggtgaaggccaaatcctgcttgaccggcgggaacgtggagatcggcttggcctggacgggcttgccggtcagcgtggcgaacagcgcggtgaggttcagctcgaaggccgcggaatgggccgggaagccgagcgcctcgttgacgcgcgggtgcagttcaccaacccagccggtgaagacgtcgcccaccatgacgcgggcgacgcggccggggtgccattggacgggcacatcgtcggcggcgggctggtcgagttcgattgcggcaccgatacggccggcgatgcggcgcacggcctcgacggcgtcggaccagtcgaccgggcgcttgccgcccatccagccatcgtcctcggccagaccggtcaggatgccggccacatggtcgggctgttcgggcagaccggcgtcaagcgcggcgagctgttcgtcggtggggcgcacgccgccgggcagtgccgggatggcgggcgcgttcggatcccacaggtagacgtggccgagctcatacagggacacgttttcgatgccgcggcggatgttgcgctgcacggtggtggccagggtcggcagaatctcgcgacgcaggtacggacggtcgccgtagagcgggttggcgatctcgacgctgaccttcttggtggcttccgggtcgaagccgaaggccttgtaatcgtcgtcgcccacgaacgggtagctcagcgattcggccatgccgaactcggcgagctcgtccgccacgcgacggcgacgctgctggtccggggtcaggcccaccagaccctcgaccggtgccggcggcacggtgatcggaatctggtcgtagccgaccagtcgggcgatttcctcgaccaggtcgcacggctcgttcaagtccggacgccagctcggcgcggttacggcgaactcgccgttgccgccgccggccaccgtgcagccaatgtcggtcaggatgtcggagatgcggttgatgtccacgtcgaggccggccacgcgggccacttcggaggccttgaagtggatgaccttggcgcgcggcgtgttgttcacgtcgttcgggtgttcgctgggctcgccgttgccgtacttggccatgagctcggcggccatctgggtggcggcgggctgcagcgcggtgtcgacgccacgttcgaagcggcgggaggcctcggatggaatcttgtggcgacgggccgaacgggcgatggtcacctgatcgaagtgcgctgcctccagaagaatgttcttggtgtcggcggtcacttcgccatacaggccgcccatcacaccggcaaggccgaggatgcgcgagccgcgttcgccgttcggcgaatcggtgataagcagatcttcgacgctcaggtcatgttccttgccgtccagggtggtgagtttctcaccctcgttggcgcggcgcacgacaatcgggccttcgagcttgtcgaggtcgtaggcgtgcatcggctggccgaggtcaagcatcacgtagttggtcacgtccacggccaaggagatggagcgcatgccggcgcgaatcaggcggcggcgcatccagttgggcgtgtgggcgttgggattgaagtccttgacgatacgcgcgtagtagcggtcgcaaccgggcacgccgtgaatcggattgttatcgtcgatttcaacatcgatgtccaccggggtgccgggctgatagtcagcaggttccggggccttctcgttcagtgccacggccggatcggtgtaggcggcaccggtggagtggtggtattcgcgggccacgccacggtaggacagcgtgtagccacggtccggggtgatgttgatctcaagcagaggctggtcgaggtgcagcaggtgcatggcgtcctgaccaggcttcagagcctcatattcagcctcggagaagccgtactgacgcagcagaatgatgccattgtggttgtcgcccagaccgagctcacgttcggaggcacacatgccgttggagatgtggccgtaggtcttgcgcggctcgatcttgaagtcgccgggcagcacggcaccgggcagggtgacgacgaccttttcgccggccttcatgttgggcgcgccgcagatgatgccgcgcggcaccttgttgccgtcttcgtcggtctcgttccattcgtcgccgcagtccacgtggcaccagttgatggtcttgccgttcttctgcggttcgggggtggcgtcgaccacgtagccgaccacaatcgggccggtcacctgagaggagtgaatctcctcttcctcaagacccaccttgacaaggtccttggcgagctgttcgtaggtcaggccttcgggaacctcgacatggtccttgagccaatcgatatcgatcataggcatggctgaatcactcccccatcacaaactgttcggcgaaacgcacgtcaccttcgaccaggtcgtgcatgtcgttgatgtcgctgcgcagcaggagcgtgcgctccatgccgacgccgaaggcgaaaccggtgtagacgtccgggtcgatgccggcggacttcagcacgttcgggttcaccatgccgcagccgccccactcgagccagccggggccgcccttcttgtcggggaaccacaggtcgagttcggcgctcggctcagtgaacgggaagtagctcgggcgcaggcgcgtcttggcttcagggccgaacatggcgacggcgagcttgtccagcacgcccttcaggtcggccatggtcaggtgcttgtcgacggcgagggcttcgcactggtggaacaccggagtatgggtggcgtccagctcatcggtgcggaacacgcggcccggggacgcgatgtacagcggcactccacgggtcaggagggcacggacctgatcggaggaggtctgcgtacgcaccaccatgttggagccgacgaaaccggcggcgtccttggcttgattgcccttgacgtagaaggtgtcctgcatctggcgggccggatggtccgggccgaaattcagggagtcgaagttgtaccattcggcttcgatttccgggccggaggagatctgccagcccatggagatgaagaagtcctcgacgtcctccatcagcttaggcagcgggtgacgggcgcccagaggcttacggctcaccggcagcgtcatatccacggtttcggcggcaagcgcggccttctcggcggcttccttgagctcgacctccttgggaccataggcgcggccgaagtcggcgcgcagcttgcccatgagcttgccggcttccttcttctggtcggcgggcagggagccaatggccttgctggccttggtcatcgccgaatcggcacctgcgtacgttgtcttgatggccttgagctcctccaggttggaggcgttctggattttctcgatgccctcggcaacctcagcggtcacctggtcggcgtcgaacaccatttgttctgccacgagaaccctttcgtctgatgttttctcagcgtttcacagcgtttttaccggtttcacattctttcaacatgacccgacatagacagcgacatcagcatcaccgcggccgaggtgccgaggttcagcgattcggccttgccataaagcgggatggagacgatgcggccgcagcgcgtgaggatgtccggttccaagccacgcgcctcattgccgaacagcacggctttcggagcctcgaccgccgccttgtccgccagtactgcgggcaggctttccggcttgcgttcttcggtgccgtatacgtcggcggcccagacgtccatattatggtcgcctgtccaggtgaagaattcgtcggtgctcatggcgagtaccggcagatggaacagggagcctgcggtggagcggatgaccttggggttcagcacgtccacgcagtcgtccacgaagattacggcgtcgcagccggccgcatcggccgcacggatcacggtgccggcgttgcccgggtcgcgcacctgccagaaggcggcaatctgcggggcccgaccgttcttgccaagttcgacgtcatcggctccggcgtgcatggactcggcattgccgacggccgcgatgccttgggtgtccggactgatgcggcgcatcacgtcgccggtgcagtagtgcacataaatcgtggcatcctgcgaggtttcgacgatcttctccaacgtggaggagatgatacgcggatgttccagcgcctgcgaaacctctacatacaggtcctgcaccacgtccggccgccaagtgacggcctcgcgcacggattgcgggccttcgataagaaaacggcccgaacgttcgcggcctttggcgcgggtcagatcggcgatgcggcgcacgcggtcggatttcggattatcaagaatctgggcgttgatgggcatagccactaccctactgccgggtcattacgtcagtcgcgagactgagggtggtcgaggctggaaccaccccagtcggctacgccgacagcccccgccagcgggggcatcataaggcgttcagacaccttgaaaggcactgtgctaatctgtcgcctttcagacaccctgaaaggcactgtgccagcctgtcgcctttcagaccccctgaaaggcactgtgccagcctgccgcctttcagaccccctgaaaggcgaagtgccaattcccggtgccgacggctacgcctatggaggccagcgggacggccagacagatgacgtagaagatccagtcgataggcttcagacgcgagatgcgggcttgggaacgtggggcgccggagccgaagccgcgcgcttccatggcggtggcaagtttggtggcacgccggatggagagcaccagcagtccgaacgcttgggagagagcacgggcgatggcgttaccgtcaccaaggccgcgcgaacgctgggacaagccgagtgcgcgccaatcttcctgcagcagcgtaaacatgcgcaatccggccaatccgccgtatacgaatcgcggtgagaagtgcagaatctcaaccagaccgtccgccaaatcagtgggatcgaggcccaaggccagaatcacgccgggtacggcaatggccgccaccctgatagccgtggcgatggccagattgatggacccctcgctgatcacaatccagccaccctgccacaggatctcgcccgaggtgcggccgtagaggaacacggagataaaactgccggcggcggcgatccataccggccaggtcttacggcatacggtccacggagccacgccaccaatccacagcagcacgaattcgatgccgagcgccgtggatgcggataccacatccagactgatgaacatcggaacgcacagcagcaacgcaccgatgatgcgactgaccgcgttgatgcgcgcgatgaaccatgagggcgatgaggctttgaccggctccacgcgcgtttcctgcgggctgacggttaccacgtcactcatgccttcgcctcctcgaacatcacacgtcgtgcgcccagcgcatccaccagcgcctcatcgtgcgtcaccatgatcacgcacgagccttggtcgcggatggtggcaatcagcttgaccatttcattccacgtactgaaatcctgtccgaatgtcggttcgtccatcaccaacactttgggtgcggcggccagcatggaagccacggacagtcgccgcttctccccgccagacaaggtgtacgggttggctttggcgaagcgcgtgagattcatctgctcaagcatgcggtcggcggtctgataagcctcgtcttggctctgccccatcgacttggggccgatggatacctcgtcacgcacaaagttggcagcgaactggtgttcgggctcctggaacaccatgccgatacggcccagcagttccttgcttttccagtcgatcggctcacgcccggcatgcgcgggcttgaggttgtcggcgatgagcaccttgccggcgataggcttgagtagcccggccaaggtcaaggccaaggtcgatttgcccgcgccgttcggacccatcagagccgttacttcgccgggataaaaatccagattgataccaacgccaagagcggccccacggccaaagcttaagttctcggtgctgagcaccggcgcatcgtgcgcagactcctgcttcggtgagtaatcgggaatcgcacggcccggcacccacgcgccaccggcggccaacacgtcgcccatctcggcgaacacctcgtccggcttgccgtcggcaatgaccgcacccgtgggcgaacttgcatcgggtcggccgagcacaatcacgcgatcgaccagatcgagccatacatcgatatgatgttcgaccacaaccatggtctgtccggtggcctcgatgacctttttgaccgcgtcatgcacttcgaccacgccttcgggatcgaggttggcggtcggttcgtccaacaacagcagaccgggcttcatagccagcacgccggccaacgcgagacgttgacgctgaccgccggacagatggcgggtggaccgatccagttcgagtccgccgagtcccaccatatccaatgattcgcgcactcgctgccaaatctcctcgcgcggcacgttgaggttttcgcagccgaaggccgcgtcatcgcccagtcgttcaagaatgatctgcgagtccgggtcctgaagcaccagtcccacgcgacctcgcacctcgcgcgcatcgacgccatcgatggtgagcgagccctcctgctcgccttcctcatcgccgccaagtacgcctgcgagaccggccatcatcgtgcttttgcccgcgcccgaagcaccgagcagcaacacacgttcacctggccggatggtgaaatcgacggcacgcaacgcgaagtccttacgcgtggcgtgccgccatccccagccgctggcctctaccgcagccggattaatctgcatcagacgcgcgccttgctgcggccggattcaaaacgctccagagcaccggtgacggcgagcgcacgagacaagtaccagaccaccacgccggcgatcacgacgccggagatgatggagcccaccagataccaagtgacgcgcaggccgttccagcccgggttggtggcccagtagtaggcccagcagcccacgccggcgagcgcaccggacaggatggtggtgccgatgttccacttcttccaagcgaagacggcgaaggcaatttcggcacccagaccctggatgatgccgacgatcagcgagccgccgacgccccactggttgcccagcgtaagttcaaggaaggcggcgagggtttcggcaaacagtgcggcaccgggcttgcgcacaatgattgcagcgagcgggccggcgaacagccagaatccgttgagcagaccctcgaaaccgggggtcacgccttcaaacagggccagcggggcggagcagacaatgtcccagccccagaaaatgacgccggatgcgacggcgatgattgcggcgacgacgatatcgacgacgcgccacttgtaattggctttggccacagcttcagtcatgaatgtgcctttcttctgctcgcacgcaggccgaacatacatggatatatgtacgcacataatgcacatgttcgtgtccacgcgcgggttggttcaggcacgggtgggtaagagcgacatttccgtgcgccggcattatccggtcacgttccatcggtcgagactatgagtctcctctcagccgcccaacggcagctcccgtgtcaactcccgactataaagcaagccgacgtcaaaggcaatagccacatctgtgacctacctgacggcggctcactaccattaccgatgcggttcggctacttgccgagcttgtccagcagcaaagcctcggtgatcacgttgttcttgaggccgggcagggagatggactcattggggctgtgggcgttggccttcgggtcttcgggaccggtgaccagcacctgagcgttggggaaaatgcgctgcagttcggggatgaacggaatggagccgccttcgcccttgttgatgggctcaacgccgaaggcctcggtcatggcttccagcgcgtccttggtggccacggcggtcggatccatggcccagcccatgccgttttcgccgcgttcgacagtgaccttggcaccgaacggcgcgtgggattcgaggaatgcagccagtgcttcctgcgcttcttcagggtgctgggtgggcgcggtgcgcagcgacagacggaagcgggtctccggggcgatcacgttgaaggatccctcgaccgggtgggcgtcgaagccgatcacggtcacggacggcttagtccacaggcgtgaggccagcgagccggtgccggcgaactcgtaaccggccaccacgccagaatcctcgcgcacggtggtttcgtcaaggtcgtgctgcaaaccgccgatcggctcttccgcggtcacgccgggtacggccagatcgccgttctcgtcatacatggaagcgatgagcatggcggccaacgtattggagtcgagaatcgggccgccgtactggccggagtgcaccggatgctcaaggccctgcacggtcacgtccacacaggtgttgccgcgcagcgaggtggtcaaagaaggaatgtccgccgaccagttgccggaatcggccacgataatcacgtcagcggcgaattcgtcgcggtgagcctcgatgaagggaatgaagcttggcgagcccatctcctcttcgccttcgatgaacactttgatattgacgttgaggtcgtcgcccagggccttcagtgcaccggagtggatggcgatgccgccgccgtcatcggcggagccacggccgtagaggcggccgtcgatttcggtggccacgaacgggtcggtgttccactcggccgggtccggaacaggctgcacgtcgtgatgggcatagagcagcacggtgggggcgtccggagaaacgatatgcgagccgatgacctcccatgcgcccggagtgccgtcggcattggaagcctgaaccaccttggtatccacacccacgaggcgcagttcgtctgccacgaattcagcggagcgcttcatatgttcggcggtgatgcccttggcggagatcgactgcagcgcgaccttttcggccagcaccttgactatgcggttccaatcggtttcgacgcgcgaacgaatctcgtcagcggtgagcgttgtcatgatggtcctcctttatatatgtgtgtgagcggcgtcattgcaatggctgcgccagtgtacaagtgtctgaacgtcaccgtaacctcaaagcatgacatggaatccgtttaagaaaaaagaagaggcccaagctcctgttgagcaggccccgaagaaggctgccaatccttctgagaaaaaaggccgtcctaccccgaagatgaagcaggctcaggccgccggtatccgtccgctggttccggtggaccgcaaggccagcgccaaggccgccaaagcccgtctgcgtgagaaggagaacgccgagtacgaggcgatgcagaagggcgatatcaaccacatgcccaaggcggaacgcctgccttggcgtatctacatccgtgattatgtggatgcccgtttcaaccttggcgaatggttcatcccggtggccttcgcgattctgatcgtctccatgttcgtcacttctttgatgcagaaccagtgggcttccatcatcatgatggcgcttatgtacggttacctgattgccgtgatcatcgacgtatggctgatgtggcgcaagctcaaggccaagctcatcgccaagtacggcgaacagtccgtgtccaagggctcccgctccttctcctacgcttggagccgttcgattcagatgcgtcgttggaggcttcccaagccgcgttacccgaagcgcggtcactggccggcagactgatgtccatatatactctggctcccctcgttgaggggctgagccgtaaagaaaacagtccagtggactgtttttaggcgaagtggcggcgatagccgcatatggctccctagcgtgggagccatacttatatgtatcaaggaggcaatcatgagcgaacagtttgatctggtcatcatcggggccggccccggcggctattccacggccttgcgcgccgccgaactcggcatgaaagtggcactcgtcgagcgtgacgccaccgtaggcggcacatgtctcaaccgtggctgcatcccctccaaggcgctcatcaccgccacccacaccatcgacaccgtgcaccgtgcggccgagctcggcgtcaacgcctcggtgaatggcatcgacttcggcacgctgcgcgactatcgcctgcgcgtggtcaagacgatggtgggaggactggccggactgcttgcccatcgcggcatcaccgtgttccgagccaatgccgcgttccatgcggatgagaccgctccagcaacttccaaccacatcgtccacctcgtcccttcccccgaccaaagcgacatcctcacctatcacaaggccgatgtccccgagcccagcggccccacgatggacctcacggccacgaacatcgtcatcgccaccggtgccaagccacgcccattgcccggcaacccgttcgccggcgccctcatcgactccacacaggcgctggaagtcaacgaatttccctcgtcggcggtgattatcggcgccggggccatcgcccttgaattcgcctcgatgtggaacgccgccggttcgaaggtgaccttgctgattcgcaaggaccgtgtgctctcagcctgggaccggagagccggcaccacgctgacccgtgagctcaaacgtcatggcgtgaacatcatcacccgcgccagcgtcacccatgtggacaccggcgcgaaccttggtgccaccgtgcactacacgcgcgaaggccaggacggcgaacaaagcgtctggggcgaaatcgcccttgtcgccatcgggcgtgacccgatcaccgacccagcatggggcgtgacgattgacgaccacggacatgtcgccacggatgcgtacggtcgcaccgacaaaccgggcgtatgggcggtgggcgatgtgacggccggtcacgcgctggcgcatcgtgcttttgagcaaggcatcgtcatcgcggagaccatcgccggactcaatcccaagccggtggacgaagccaccgtgccgcaaatcgtgttctccttccccgaagcggcgtcggtcgggctcaccgtcgaacaggcgcaggcgagagaggatctcattgaaatcaaggagaccaactatccgatgctggcgaacgcgcgcatgctgatgagcggcacggccggttcactgaccatcgtctccggctgcgacgcggccaacccggacaccccgcgcgtgctcggcgtgcacatggtctcccagatggcctccgacatcatcgccgaagccgaacagctggtcggcaaccatgtgccgctcgccgacgcagcccgcctcgttcacccgcatcccacgttcagtgaaacgctcggcgaggcgctgctcaaggccgacggacggccgttacacacacgctgagaccaaccagcacaaacaagttcggaccagcgcacctgataagatgctgtctagtgtgtttcgtcccaacaaaggaagaagtgatggcggaaaaggacgcgaagccgaagaagcagagcacaatcaagcagatcatccagatctacaagtacacggctaaggaagacaaggccctgccgtggcttgaggccggtgctttcctgctgcctgtagtcgtgatgatcatcatcggtctgattgccaagtggacctggctgacctggatcttcaccatgatcaccgccatcatgctcggcatgctactggccaccatgatgctcacccgccgcgcggatgcagtcggctacaagcagattgacggcaagcctggtgccgccatcggcgtgctgagcaacatgcagaaagccggctttaacttcccgcaggaaccggtgtggatcgacccgaagaccaaggatgccatctggcgcggcacttcgatgaacggcatctacctgatcggcgaaggcgaatacggtcgcatcatgaaggcgatggatcgtcaggaacacgatatcaagggcgtcaccgccggctcctccattccggtgtaccgcatctccgtgggccacggccccaagcaggtgccactggacaagctgcgtagcacggtgaccaagtccaagagctatgagcccacgaaccacaagaacgcactgatcgccaagattcatccgcgtcgtcgcttcctgctgaccaaggccgagatggaaacgctgaacgatcgtctgcgcacgctgcaggccaagaagggttatgccatccccaagggcatggacccgaaccacccgcagaagatctcccgccgcgcgatgcgcggtcgctgatcggcagcacaccaccaaatcgcacagaagccccggaatccgttcaatcggttccggggcttcgtcatatgtctcataatcgcgtccacatacatccacctacgtcacctgtcaatatccactgtccacgttgcggacatctctacctactcccccgatagcctccgtttccattctgtaatgatgtttcgttgaaataacgcgcctgcgcgattgtcgaccacagtcacgaaacattctcgtaacccaagtttcgagccggcgaaacgcgctattttacgatatataccgttatatctcatacgaaaggagcggtcccgtgaccgaactcaagtccaaggaagacgtcgaggcccttatcaacaaggaaggcatcgagtatgtctccgtccgtttcaccgatcttatcggcgttcagcagcacttcaccgtgccggctagcgaattcctgaaggacgctttcaccgacggcatgccgttcgatggttcctccgttcagggcttccaggccatcaacgagtccgacatgaagctggtcccggacgttgagacctctttcgttgacccgttccgcaagcacaagacccttgacgtggccttctccatcgtcgacccgctgaccgacgagccgtactcccgcgacccgcgtcaggtcgccggcaaggccgaggcctacctgaagtccaccggcattgccgacaccgcatccttcgctcctgaggccgagttcttcatcttcgacaaggtgcgtttcgagaactccatgcagcgctccttctacgaggtcgactccatcgaagctccgtggaactccggcgttgacgttgaggaagacggcaccccgaacatcggtttcaagaatcgcgtcaagaagggctacttcccggttccgccgattgaccacacccaggatctgcgcgacgatatggtcgccaacctgcagaaggtcggcctgatcctcgagcgttcccaccacgaggtcgccggcgctggccagcaggagatcaactaccgcttcaacaccctgcagcacgcaggcgatgacctgatgaagtacaagtacgtcgtccacgagaccgccgctctggccggcaaggctgcgaccttcatgccgaagccgatcgccgacgacaacggcactggtatgcactgccaccagtccctgtggaaggacggcaagccgctgttctacgacgagaagggctacgctggtctgtccgatctggctcgctggtacatcggcggtctgatcaagcactcctcctccgtgctggccttcaccaacccgtccctgaactcctaccaccgtctggtcccgggcttcgaggctccggtcaacctggtgtactccgctcgtaaccgttctgccgccatccgtattccgctggccggcacctccccggccgccaagcgcatcgagttccgcgctccggatccgtcctgcaacccgttcctggccttctccgctcagctgatggctggcctggacggcatcctgaaccacatcgagcctccggagccggtcgacaaggatctctacgagctgccgccggaagagcacgctggcatcaagcaggtgccaagctccctggccgaggctatggacgccctggaagaggaccacgacttcctcaccgccggcgacgtgttcaccgacgacctgatcgagacctggattggcctcaagcgcgacgagatcgaccaggctcgcctggccccgaccccgctcgagtacgagctctacttccacatctgagtttgagagcttagccacgttggaattcccattgctcttccctcgtgggagtctaatgggagtcattcagcgtaactagaaagaacctcgtgaaattcgtttcacgaggttcttttttgtatgttgcgttgtgtgttatgcgatgtgtgttgctcctggaatattccaggggcgggccgctacttagtctcccaacgctccttgagtacataggcggcggctttgggctgacggtcgcgagtgaagacgtccttcttgttgccgtcgacgcgcatgataccttcaccggtttggaagtcgcagaggttccatacctgctcgcccaccactgcctcgaacatgtcgaacacttcgtgctgcatggtgaggtactcgcattggtactcttcactccattgcatgctcggcagcttgtgcacaccggcatcggtgtccgcaccgtattcggtgaacagaaacggcttgttgggttcggtgttcatccattggttcatctcgttgatgaaggccttcttggctccgatgagctgatacccatcttgcacataccagccgtaataccggttcaggcagatgacatccgcgaactgatggcacttgtctttgcctccggcggccatcagcagattggtgtaggtcagcgggcgatgctgcggatcgagcgtgcgcgcgtaatcgaatatctccttgaaatacggcacggccgcctcggattggagtcgttggcggcgtcgatgaaattccaagcgccggaggccccggcattcttttcgtcgaaggggacaattcagaacacaactgccgacacaatcgtcagggaggccagcgagaacagcgtgcttacgagcacgaagccgaccgcatactcgggcatgttgttcttgcgaccggtgaacatggcgatggtggtcatggtcggcagtccggcgatgaccgtgatcatcagcaccatgtcatgggtgatcggcagttgcggcaatgcgccggtcagcgcggtcagtagcgcgtagaaggcgagcgggaatgcgatcatcttggcgactaggccagcatagagttcgtagcgtttgaggacgccccaccacttggtcagcgcgaacaggccgcccaagtagattagcgacatcggcgtggccatattgccgatggtgtgcagcggcttcaggatgatgtccggcaccttgacgccgagcagaatcagaatcagggcgagcatcacgccgacgaaggcgggattgacgaatcgtttaagcaggccgaggacgcgggtgcctggcgaggggcggacgatggccggagaaccaccgtttgcggcattgctcgccgaaccagcattgcccaccgaaccggcgccgttcaccgaaccgttcacgaccgcacctcgcgcgccaatcgcgttgccgccagtcgtttcgtcgaccggctcgcacagccatacgccgtacgtccagagcagcgtttggtcgatgatcgacatcagcgccacgtaaatcgcgccgttctgcggccaaagtgccataatcaacggaatgccgatgaatccggcgttgccgaaaataagcgacgcctgaaatacatggctacgcgaacctttgagccgcaacagttcggcgaccagccagaacaccaggatgagcagcgcgtacatcacggcggtcagcagcatcacgccccagttagaggcaagctgcgcgcggtccgcaccatcgacggcgttcgaaaacacaagcacggggatgagcacgttgagcagcaacgagcacatgccgtccaacgccgtctgaccgtagaatcgaagcctcacacatccatacccgaccatcagcatgatcagaaatccgactaactggccaatcatgacgccgaactgccccatgcacactcctctcgctcgcgttcccgtgcttttctgtcactggttcatataggcagccatctggacaggctcggcagcacacgcatcagtatgttcgataccaccacatgccaatccacttctcgttcaaccgttccccgtgctaatgcgccgccggccaccccgtgttgccggtgctgcgcgagcaccattacacgtattgcattccggtgatcagcgggcgcaacgtgtgggtcggcgcgaacgtgtcgattctgccgggagtgaccatcggcgacaattgcgtgattggcgccggttcggtcgtgacacattccatccccgccaactccgtcacctacggcgcgccctgcgaggtcgtgcgtgaaatcggcgacaaggaccgcgagtatttctacaaaaatcgcaagctcgacgtgtgggagtgagctttcgcgctactgctctttgagcttaaaacgctcactgaattggcggtcgcgccagtagtagacgtcgtcgcgttcgttgatttcgcgaattaccttgcacgggctgccataggcgaccgtgttggcggggatgtccttggtgaccagcgagttggcgccaatgaccgcgttgtccccgatggtgcccccgggcagcacggtgacattcgcgccgatccagacgttctcgccgatgtggactggcaacgaatactgggcaccctgatagcgcaggtccggacgcacgggatggccggtggctacaagcgtgacgttggggccgatcatggtgtgggatccgatgaagatctcaccatcgtccaccagcgtcaggttgaagttggcgtaacagcgctcgccccaataagtattgcagccccagttcgcatacaccgggcattcgaggtacagaccctcccccgccgcgccgaagaacgcctgcatgagttcggtacggcgcttcgggttggtcagcggcgtggcgttgagttcgagctggagatcacgctgggcggcctgcagatcaaaaaagccgtccacatcatccggcaggtagacctcgccagagaacataagcgccattttctcgcgcgtcgcatcatcgataatcggcttggcgatcggcttgtcttcggtcatcattggctcctgttcggcgttttggcgattgtgtcggtcgaactattctgtcacagactcgttttcgacacccagcatcgagcgcagccagtcaagttcggcggcaatctcggcgtcatgcacggcgatgatgccacggcgataggggtcgtcgatctgctcggtggagagcggattgccggcgtcacaggcatcaccgtcaaggctggcgccaccgtgcaggtcatcgaccgcaacccggacaaggccgcagcagcagcggctgaaggcgtcaccaatcagaccccatggaccagcggttttaaggttgtcaagtaagcggcatatcgcagcgaatcattctcaataagaaaagtgtgaggcaaacgcacaatatcactcaatcgcgtattcgcgggaatagcatcaaacagccatttcttggattcagatgtgcgattggcaccgtgcgggcctcacacttttcttattgagaacgattcgccgtgcagtcaagccctccatccacccaaaaaggactcgcttttggccgcgtcgtcgcggtaggccttgccgaactcgtcaatgagcccatggaattcctgcaaatccttgacgctgaggctcgcatccagcaccacgggcgaataggccttgtggaatgccagatagccggttggcacatcaaatccgaggaaggcgaatagtcggcgagcataagtatcggccacgaatgtgcggcgcgaaaacacatatagcatcaggtcgtcggccgtttcgcccccgataccgaataatccgagcaattcggtccgcaattcggcgtcgggaatatctgccgcgccctcaggcgaggctccgcaacgctccacataccatcggctcagtgactgtaccgtcttggatttgttgacataaaagccggacgggcgaataagttcctgcagatgcgctggccccataatcgccagcttatggggttcgagcacaccctccgcgttcaacgccgcaagcgaacgattcacattgccccacgccgtattctgcgtcagcaccgcgcccaccataatctcgaatgtggtttcagccggccaccatccggtcgggccaagggcggcagccatggtgcggtacagcgattcgatatacgcgggagaaggaacgcccggcacccgctttgcacttcgattattcatagttgccatctaccattcaccgcaattcatgcaggattcgccgcatgaacgggatagtgactaggaatgtcagcacgtcggacaccgattgcgccatttccacgccgagcacgccaaatatcatcggcagaatcagcacaatcggtgccaggaacaggccttgtcggcacagggccaggaatgaggcgatgccggtgcggcccatggtctgggtcatcatattgcccatcatgttgaagccgttgagaatcaccgtgcagcattggatgtgcagcgcggccacgcccaccgccaccacggctgggtcggagcggaagatctcgaccagttgcggtgcgaacacccacagcagcgctgccaacgccacgagcacgcaggtggcgagccgcacgcagaaccaatatccctctttgactcgcgcgaacaggccggccccgtagttgtaaccacataccggctgaaagccttggccgagacccacgatcaccgaattggcgcccaacatgatgcgcatcacgatggccatgccggcgatggccgcgtcgccgaacggattggcggcaatgttcacgcaggtcacggaaatcgaaccggcgccttggcggatcagcgagggcaggccaccgccggccacttcgcgcatgagcagcatatccggtttgcaattgcgcagggacagtttcatcacgccgaatttgcggctcattgtggtcagaatcgtgaagctcaccgtctggcagatggcggtggccaggccggcaccaaaaattccgaggtgcagcacgaagataaacaacggcgcgagcaggaaattcagcaatgcgcccgaaaccagcccgatcatgccgaacgtcgattgcccttggtatcgcagcagtccgttgagtgcgaacgaaccgcacacgcagggtgcggcgaccagcaacggcgtcagatattgcacggcgtatggggcgatcgtcgaggtcgagcccagcatgacgacaagtggccgcagggtcagcagtccgattgtggcaatcaccagaccggagatcaccgcgcccgcaaagcccacggccagtagtcgggaggcgcgatcattgttctgcttgccgagttcgcggctcatcgagttgcccgcgccgttgccaaagaagaagccgagcgcctgcatcacggtcatgatggagaacgcgatgccgatggcaccggactgcgcggtgccgagctgaccaataaagaacgtgtccgtgagattgtaggcggtggtcaccaagttggagatgacggccggcaaacacagtttgagaatcagcggcttgaccggctgcccggtcatctgccgatatttcgcgtccgcgcttgcgcgtctaatgccatgaatctgcaccatggacggctatcctactcgcgcagggtcctatgcaaaggcgcgttaccgccatacgagtcagcgcagataccgcccggtgatgctgttcggattggccgcgatttgttccggcgttccggtggcgacgatgcgtccgccgctttcgccaccgcccggacccatgtcgatgatccagtccgcattggcgatcacgtcaaggtcatgttcgatgaccacgactgttgcgccgctcgccacgagccggtcgaacacgcccagcagcacgcgcacgtcgaacgggtgcagaccgatggtcggctcatcgaacacgaataccgcgtccgattgggccttgcccatttcactggcgagtttcagccgctgggcttcgccgcccgaaagcgccggcgtcggttcgccgagcgtcaagtagccgaggcccaagtcgtgcagggtggtcagacgtgcgtgaaccttcttgaggtcgccggtcacggacagcgcctggtccacgctcattgccatgagttgaggcaggctcagggaaatgttgccgccaccctgatccgtcgcctcactcaatttttccttggcagctttgcgtttatccgggaccttcatcttcgccgctttgcccttagccgctttaaccgcacgccgaatcgcgtcggcttcggacgcatagcgggagcctccacaatccgggcattcgatggtcacgtccggcaggaactgcacatcgagcgagattgaaccggtgccgtcgcatgtggggcaacgcagtcggccggtgttgtatgagaaatcgccagccttccagccgcccgccttggcgccgtccgtgcgggcgaaggcgcggcgcaattcgtcgtgaatatcggcataggtggccacggtggagcgtacgtttgcgccaatcggcgtggcgtcgatgagattcgcacgatggatgccctcggcctcaagttcacgcacatgttccggcaaccgctcccccgccgcctgcgctttgagcgcgggaatcagcgattcgagcaccatcgtggttttaccggagccggagacgcctgtcaccgccacgagccggccgcgcggaatatcaacgtccagcggcttgaccgtatgcaactggctggttgtcatgcggatgcggccaaggtcgaacacctgcggttccgccacgcgctcacggatgcgcgcgctcacattatcggccaagaacggcgcaatacgactacttggattcgccgccacctcgccgaccgtcccttgcgcgatcacatgccctccttcggcgccggcaaccggtcccatttcgataagatggtcggcggccttgagcacgcgcacgtcatggtccacgaccaccacggaattgccgtccgccaccaagtcatgcatcacgccgagcagcccatccacgttcgaggggtgcaggccaatggacggctcgtcgagcacatacagcacgccggtggtgcggttgcgcacggcacgggcgagctgcacacgctggcgttcaccggttgaaagcgtggcaccggcgcggtcaagcgccagatagccgaggcccagatccaacagtcggcgggccacgtccaggaatgattcgcagatgttggtggccatcggccgcatgtcggcggacagagattccggcacgccgcgcacccaatccaccgccgcatccaaggtcatcgcgctggcttcggccaggttcagcccgcgcacatgcggggcccgggctgcggcgctcagtcgtgtgccgccacagtcggcgcatggtccctccttgagaaatcgagccacgcgcttcagacctttctcgtccttggctttggcgagcgcgttctccaccgtgtatacggcgttgaagtaggtgaaatcgagttcggcgaaatcgtcgcctttcttcggcttgtaaagaatatgctttttgacggccggcccgttgaatacgatgtcacgctcttcgggcgtgagctcgctgaacggcacgttggtgcgcacgcccatcgcgccgcacacctgcttcataaggtcccacatgagcgagccccatggcagcaccgcaccgtcgtcgatacttttcgactcatccggcaccagggccgcacggttcacttcgcgcacaatgccggttccggagcaggtcgggcaggcgccggccgagttgaaagcgagcgattcggcgccgggcgcgtggaattccttgccacagccagcacaggtgatgggcagtccggccgccacgttcagcgtcgactcgttgcgcgccccgcaatgcgggcacacgtgcgaggcaacgcgggagaacaggagccgcagactgttgagcagttcggtcatcgtgccgaacgtcgaacggatgccaggcaccgtgggccgctggtgcagggccagcgcggccggcacgtgcagtacttcgtccacttgggcgcgactggcctgggtcaggcggcgtcgcgtgtacgtggacagcgcctccaagtagcgccgcgaaccttccgcatacagcacgccgagcgccagcgagctctttcccgaaccggagacgccggccacgcccaccagttcgcccagcggaatgtcgatgtcgatgttcttcaggttatgcacgcgcgccccgcgcacttcgatcgcctgcggccgttgattgttggtcatgctcggcaccgctccgccgccgcgctatctgacctctgttcaagtgtcacgccgtcacctctttctcgacttcgcccttggctgccgccgcctgagcttcatggtctccagtatcatcacggccaacgacggcggccgaacgacggacgagaatctttcgtcttgggcaccgtccgccacctgcaattcgaactagctgaaccagcgtgacgatattgtcggctatcgatctgccgtgatcgtaatggacatcgtcgtccggaagcacgtcacctgttccgagaggagtcggcggcgcgctttcataagggcacacaatcccaagatcacacgcgcaacgcctctgggaacgagccctaatagcctgaacgggattccctaaccccactgcccacgtccgtccaatcaggcgtgttcattgggagttccaacgagaacggcatttgcgtcatctcctaccaatctcccaacggcaaggcgcctgacgtaattgtcgccacccccgggccgtggccctcggacgacatgcgaggcttggccataaccatttgggagaatggtgtggactcggcacaaatgcgattgatgaacacccgtactggagagttcggcacaagatggcctgcaagattctcatgggttgcgatatggaactagctttccctaacccctgtcacgggccaagtcaggatgccgtattccgacaggtatatcactctggttcgtgtcggccgtattgtcaccgcctgcgcgtatatcacgctgacaagcgatttcaatcaggtcggcaacacatccgtcaacgagacaatcccgaagggtttcagaccgtccggcgattcccgcgcggtcatgcgcggcaccgacaacagcggcgcgaccagtttctacctttacggcacgccggaggggaaaatggtgttgaacggcaccggatataccggccgattcgtcggtatatccggctgttggattaccgcgtagctttccctaacccagcgttccacgacatggagggtcccctacagcaacaacagtatttcgctgacgcgcgtgggtgatatctgcttcgcgggcggcaacgtgaaattcaaccagagcggcgagaacaactacacacaggcgcgggagaccatacccgtggggtatcgtccagcggaaacgtcgaacgttcccatcgccgtgttcggcggcaacaccacgttcatcctctacggcgagcatacgggccgtgtggtcatgctcggcaacccgaacaacgcatacgcgggatgcaccggcgtatggaggaccagcgacccaatgcccgccgcatagcttcgggacactggttcaggcggttgcgctgtcttgcagtgaccccacgggtcatagcgcgtatgagacggtcatgccgaacgcgttcgtgccctgcgtgccgccctgattggtgtaggtcatggttccgttcgcgtttacgttgatgatcttctggttcgcgccgtcgcgtccgccatatgagaaattcaaatccattggaggacgccagctttcaggcagggttccgaaattgccggtgttccacgagccggacgccgacgacttccagtcgatgcgcaacgtgacgagcgagccgcgacggtagcctttgacggtaccgtaagtggagttaatcagcgtcagcacttcggtctgggttagggaaaactattgcctgttccagattgcgatccagcttccgaatatcgcgaccctcccgcaccagcggttgtctttggtgttccacaggcggaagcgtatctggtttacgtcgctggtatcccaacgttgtgcggtgtactcgccggcctggtcgaaaccagtgccgaacggcccaatcgtgtaggccgcgtaatcggctttcttcccgtttggggattggacgttgatgtagaatgtgccgtcatcattcgtggtgatggtatggcctccgcacagaatatacggcattcgggttagggaatcccgttcaggctattagggctcgttcccagaggcgttgcgcgttgatctcggccgtatccaaggacttccatgtcatgtggggcacgggttcgcccgcagtggcgatcgagcactgccataacccgcataccaggccggacgtgccggtgtcggatatggcgttgggggaaaaaatcacgggcgctgacgtgtgccggcgcatccgtcgcaggagcggcgggacgggcagcgtgttcacgtacgtgcaccgcgtggccgacaagctgggagtcgccagccgcaaggaggtgctggacgcatgcgccagatacgatctgctctgccccggctttccgaccggcttggcctgcggcatgccgggcatccggtgatcgcggcgtcctgcgccgtattgtccgtggcggtgctcgcggagtacgtgttctcgatggcggcacgggtccccggcaccgcgaccgtgcgcgatatcatgttggctctggctgtgcttgccggcctggtcggcggcatgttccacccggaccggttcctgtggcccggcgcttgtcacgggcgtaatcctcatgctggatgtcccgatggtcacgccgggaccgacggcatgcccgccgacgaacacgaataccagcaacagctcgacgaattgcgcgacgccgccagccgggccatgggccacacgcacgaggtcatcgactcgctcgaagaacacacaccagcgcaagccagccggacaccgaacaagcccactggcagctggaggccgtcattccctttaccggcgtgttacagacaatggaatggtgatgttcgcgttccagttgtcggaatcatcggtgatgtcgaacgtcccggacatggattcgataacggttcggtatctcttgaggccgctgccgagtccgagccgtaccgcttcgtcctttagtacgtcgcttgccgaaatgatgacgtgccgccggtcgaaggagatcgtgacggcgtaccattcgtgcggggcggcgtgcttggcgatgttcgcgtacagttcgttgagcagtccttcgagaaggtcgaggatgtcgtccgccagtggatggtcgaacgtcccgaggatgtcgtcaccttggaatccgaggccgccaaggcgacgtcgttgcgattgaatgatgccgtcaagccgttcacgctgctgttcgattttcctgtcggttttgtcgtcgttatttgttttgacgatgcggctgcgatcgtctggtttgtcggtgcgttcaagttgtcgtatcacctggtgggtgtggtcgagcgccgtttcggcgatggcgcgcagatcggtgagttggcgctgatattgctcccgatcggcggggcaatcactgcggcttgcctggtcgatgcgcaggatcatgtaggcgaggtcgttgctgatggtgtcgtgcaggtgacgcgccgtgtgttcgcggtcgagtcgttgcctgagtgtcgcggtcgcctgccgttgggcgaacagcaggttgagactgaaccccagcgacaatgggcataggcacatgatgatcatgcctacgatgttcgacgaggtgaggaatacaaggcgaccgtcgaggatttcccctttgaactgatgaacggcgatgcgtttccagcgaatatacccaaggcgcaggccgcgtcctcgctgtatgccaagggaagtggggaaggacaggcgtatgtctactggcagtgctcggtggaacgcgacattctcgacaacagccagaccaacgcggaagcagcccgaggcgccctccagcagctgcgcaagctgctggataccgactggttcaagaactactacgaggacaaggatggcatatacgagaacgatgtgatcggcaaatccgaactcggcgactattcgaccatgcgggacttctacaccacggactgcacatggtaccggcatgagaacggactgacgaaatgaatgcgatcgcaccgttcaaatgcctgttggcgtgcgtgacggccacgacgatgtgcgcgatgatgaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgccgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggcttcgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctaaaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccgcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaacttcatgaaaagcatccgaatagatgactctcaaaacaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaccgacagggtgtgggagagtagcacgccgccgcaccacacgtacaggaagcccctcggagcacacgccccaaggggctttcgcatacccgaaaccaacaagacaagacaccgacaagacataggctctcgcacctagggtgtggccgaatcgaaagcatatagaagagggaaccctccaatgacggagagttccctctttgcgtatctggaccgataaaggtctagaaattgaaattgtccggatcagcaccgttgcgcttgccggtgttgatggcggagatggcggtcatatcatcgaccgataggttgaagtcgaagacctcgaagttctgcttgatgcgctcggcatgagtggacttgggcagcacgatgataccgcgctggatgtgccaacgaatcactacctgtgcagcagacttgccgtacttggcaccgatttcggccagtactgggttgctgagtaggttaccgccggtgccgccgagcggactccacgcctcggttgcgatgcccttggcacgaagctggccaataagctcttgattggtgaattgtggggaagactcaacctggtctacagcaggcaccacatcgctatgggtcagtagctcatcgatatgatgcttttggaagttgctgacgccaatggccttggcacggccagaggcataaatctcctgcaagtcgtcccatgcctgctgccagccgtctgctggccagtgaatcagatacagatccacataatccacgcccaagcggtcgaggctttcttggaatgcatccttgccgcggcgtgcgcgaatatcgtcattccacagcttggtggtcaagaagaaatcgctgcgcggcacaccagcacggcgaataccttcacccactgaagcctcgttgtggtaaatcattgcggtatcgatatggcggtagccattctccagagccgtctgcaccgcgttcactgtagtatcaccatccggtgtctggaatacgcccaagcccacctgcgggatgacagtgccgttgttcagcatgattgtcgattgaattgccataatgcctcactagtcgtagtattcgttcaatttcccattctagaaacaagacgatgcaataagccgcgttttgctggcaaagaatgattcttttttcagcgctacgatgaacgatatgactacggaatatgtggctgcatttgatgcggggaccacggcgttgaagggtgccttagttaatgggcagggttgcattgtagctagtgcgagtagcgaacttgaccttattatcaacggcgactatcgggagcagagccccgatcaatggtggcaagctttctgctcggcctccaggcacatgattgagcaggcgcggcaatccgagtcagaattcaatgtgactcgcattcgtggcatcattttcagcggtcagatgcaggatgttattgttttgaacggcgagctcaatcccgtccgcaatgccattctgtattcggatggccgagccgaggaacaggccaagcaactcgccgagacatatcagggcggtgcagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattaactggcgaatgcgtgggcgatgtggcggcgtgttccacagctggggccatgaatatccgtaatggccagtgggatgccgaattatgcgaggtcgcagaaatcgacatgaccatattgccacacctgcacaatccgcaagacaacattggcacagtgacggaatccgctgcacaacgcaccggtttttccgccggaactgcggtatacgcgggcattggagacgcgggtgccaccacacttgccagcggtgtcagccaccctggtcaatacaacatcaatatcggcacctcaggctggatcgccaccgtttcgcccgagccgttcaccgacaagccaggtgctgcgaatctggcatttggcgtggaagaaggcttcgtgaatgccgtgccattcctcaacgccggtgacgtgcataaatgggttaccggcgtattctccgatggcgattacgcagaggcgcatcagcttatcgaaacatccaaacccggctccaacggtgtgctatgcctgccatatctggtgggggagcgattccctgttatgaatccgaatattcgcggtgcctatgtgggcctcgatccagacaccgccaaggcagacatgatgcgtgccgcgcttgagggtgtggccttctccattcgtcaaggtatggaaagttttgacgccaaacccaccgagatttccctgattggcggcggagccagagaaaatgcgtggtgccagattctggccgatgtgttggagcatcccatcgaagtgttcgccaatgccgatattctgccagcagtggcaatggcctcgttggtattcaatgtaccagacctgctgcaatcagtatgcgaatgcactgtataccagccgaatcctgacaccgcacgcacatatgccgacgcataccggcgattcctgagcctctacccaatgctgcgaacgatggattaggaactgagcatcatgaggcaatcggcgaatttggtccgcaaacatatagtggtcaccggactggtgcaaggcgtgggattccgttattttacggtgactcaggcacgtcggcttggtgtacagggctgggtgcgtaattgccgcgatggctcggttgagctggaagcacaaggcagcagcgacgcagtgcaagccttggttgagcaattagccattggcccgcgatggtccgaagtgagtcacgtcgccgtgcatgacatgccgattatcgatgagaccgctcgggcatttggcgtgcgtcaataacctgtatcacgaacccacatcacgcacgataatctcacgatacgggtgaacatgggcgttcctcgccgcttaggcctcgcacattgctacgatggggcgttatgagtgagaacatcatgcgaatcattgacctgcgtggtcagaacctgtcccgtgccgaactgcttgccgcgatgccgcgtgctgcaatgggtacttccgaagccaccgatttggtgcgtccgattctggacgatgtcaaagaacgcggcgccgctgccctgcgcgacttcgaggagaagttcgatcacgtgcgtcccaagaacctgcgcgtgccggtcgaggcgatcaaggacgccctgaccacgctcgaccccgaagtgcgcgccgccatcgaggaatcggtgcgccgcgcccgcgccgtggccgccaaccaggtgccgaaggacttctacaccgacctcgccgaaggcgcccgcgtggccgaacgctggattccgattcagcgcgtcggcctgtatgtgcccggcggcaaggccgtctacccgagctccgtcatcatgaacgctgtgccggcccaggccgccggcgtcgaatcgctggccatcgccaccccgcccgcccgcgacaatgaggaaggcctgccgaacaagaccatcctcgccacctgcgccatcctcggtgttgacgaggtatacgcggtcggcggcgctcaggccattgccatgttcgcatacggcgccaagggcagcgagccgcaggacggcgacatcctgtgcgatccggttgacaagatcaccggcccgggcaacatcttcgtggccaccgccaagtcgctggtctccgcattcgtgggcattgacgcggttgccggccccaccgaaatcggcatcatcgccgacgaaaccgccaacccgagcctgctggccgccgacctcatcggccaggccgagcacgatgagctcgccggttccgtgctgttcaccgactccaccgagattgccgacaaggtgcaggagagcctcaagtaccgcgtgccgcgtaccgagcacgccgagcgtgtccacacgtcgctgtccggcacccagtctgccatcgtgctgaccgacggtctcgaccagtccatcgacgcggccaacgcctacgccgccgaacaccttgagattcagaccaaggatgccgatgcggtcgtcaagcgcatcaagaacgccggtgccatcttccgcggtccgtactccccggtgccgctgggcgactacatgtccggctccaaccacgtgctgcccaccggcggcaccgcccgcttcgccgcaggcctcggcgtgcacaccttcatgaagccggtcgaagtcatcgaatacgacgaggaaggcctcaaggccctcgccgcccgcatcaacgccttcgcggtatccgaggacctgcccgcccacggcgagtgcgtgctctcccgcttcgtcaaggatccgtatgacaaggccaccctgcgcgagcaggagaaggaagccggtctgcgatgagctcgattcctgcaaacctgccgctgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacatcgaattgcgtcaggcattctccgattacctggcccgcgaatccggtacccgtctggacgtggacgagctgtggggtgccaacggctccaacgagatcatgctccagctgttccaggctttcggtggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcactagcccaaacaacccgaccggcactccgttgccgatggaggatatcgaacgtattctcgccgcctgcgaaaccgctgaagtggtcggcgcgggcgagggcgtgcatccgattctcgtcatcgacgaagcgtacgtggaattccgcaagcccggcaccccgagcgccgtgagcctgatcaaggaccacccgaacttggccgtcagccgcaccatgagcaaggccttcgccttcgccggtgcgcgagtcggctacctggccgcgtccaagggcatcatcgactgcgtgcgtatcgtacgtatgccgtaccacctgtccgccgtgactcaggccgccgcactggccgccttcgaacacaccgacgagcagctgagccgtgtcgagcacctgcgcgaaacccgcgaggccaccgccgcatggctcaaggaacagacctacaaggaccagccgcttgaagtggccgaatccggctcgaacttcctgctgttcggcgggcacttcgacaagcgtgaagccatcttcgacgagctcctgaagcgcggcgtactcatccgcgtggtcggaccggacggttggctgcgcgtgtgcatgggcaccgacgaggagatggaaaccttccgtaacgcccttgttgaagtgcttcgtatagtggaagcagcataagggacgtttctttccgattgcggcgagacccgaagcgattcgagtcccgccgcaatccaatatgacgaatcacataggagacatgatggcaagaaccgcgcacatcgtccgcgaaaccagcgaatcacacatcgacctcgaactgaacctcgacggcacaggcaaaaccgatatcgatacatccgtgccgttctacaaccatatgatgaccgcgctcggcaagcattcgctgatcgacctgaccatccacgcccacggcgacaccgacatcgacgtgcaccacactgtggaagatacggccatcgtgttcggcgaagctctgaagcaggctctcggcgacaagaaaggcatccgccgcttcgccgacgccaccgtgccgctcgacgaggcgctggccaaggccgtggtcgacatttccggccgcccgtactgcgtgtgcagcggcgagcccgaaggctacgaattctgcatgatcggcggccattttaccggctcgctggtccgccacgtcatggaatccatcgccttccacgccggcatctgtctgcacatgcaggtgctcgccggccgcgacccgcaccacatcgctgaagccgaattcaaggcgctggcccgtgcgctgcgcttcgccgtggaaatcgacccgcgtgtagacggcgtgcccagcaccaagggagccctgtgatgaccgacgacaagttcgatccggacgaatcgcacttctccgacgaggagcttgaggctgcgctcgccggattcgagaaagaattcgcggacgattcggtatccggcgatgccagtgataccagtgatgccgataaaacagcggacgctgcttcagcgaagtccgattccgacgcgaatgatgatacggctgataaggcttccgctgattccggccggcctatgaccgacgacgtcaccgggtccgttgcggatgcggtgaacgaggccatggccgatgtggtcgacccctcgctcggcttcgacaacgaactcgctggactgttgggtaacaaggcgaaggtggcgctgatcgttacccgtcttgcctccgccgaactgttggccgcgttctgccagctgtcggacatctccgccgcatgcatcggtgccaatcagggggccgtcgcggtgctgaagaatctggacggcgacggcccggaagccgcagccaaggacctgaccaccgtggtatccggcatggccgtgattcttgcagtcaatcgtgccgacaagctcgaagtggccatgtacgtgcagggagaggccggccagagtttcgcgccgcccgtgctgttcacctccacaccgcgcttcgtcgaggacctgatgctcggcatcgtaaccctgaaccaactcaagacccaagggttcgaagtggtggattccgctggactcgaccatgatcaggcgatgcagattctcgccaaccacactaggcgcggacgtggcgggcgcggctcccgcatcgaatagacgccaaccaaaccagtaggggataggagagcagatgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaaaaaagcatgaagctccctctgacgagggagctcaaattgtgtataagtaactgaagaaaggctcttcttatgtcgttgactctgctgcccgccgtcgatgtacgcgatggcaaggccgtgcgcctgcgccaaggcgaatccggttccgaaaccgattacggttcgccgttcgaggccgcccgtacttgggttgaggccggtgccgaatggattcacctggtcgaccttgatgccgctttcggtacgggcaacaatcgcgatcagctgcgagaaatcgttcatgagctcggcgaccgcgtgaacatcgaactgtccggcggcgtgcgcgatgacgcttcgttggacgcggcccttgaggccggtgccgcccgagtgaacatcggcaccgccgctttggagaatccggattggaccgcctcggtcatcaagaagtacggcgaccgcgtggctgttggtctggatgtgcgcggtcacacactggcggcgcgcggctggacgcgcgaaggcggcgacctgtttgagaccatgaagttccttgactccgtgggctgctcgcgttacgtggtaaccgacgtggctaaggacggcatgatgtccggcccgaacattcaattgctgagtgaagtcgctgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgcttgaagtagcgaagtaggcaaaggactcgccttagcgagactgttaatctaccttcgctcagctatcgcttcactcagacctctcctacggacagcccattgggctgtccgcttaacggctcagcaagggaggtcgccggatttgaggagctttttgaagacggcgtagtcttcatcattctgttcggcgtagctgacggcgaatgaggcgatggcctgatcgaattcgtcggtgccacccatgtaattggcgatcgcaatcgaatcgccggtgcgggcgtgggcgtgcgccaacgaccatgcgcacatgcgtgacagatcgctcaatcccgaagcgttgagattgtcgatatcaatcgaccccttgccattccacaactggcgcacgtaatagtcgcgcggtcggccatcctcggccataaagctcgaccaacccaacagcacatcggccgtattctgaatcagcttctgcccctgaaccacgcgctcaccgtgcgtggcgtacggcgacgcgccgcagtaatgctcgagcacggaatacgtggcctccttcatctgaatcatcatcggatcgtcgatatcacgcgcgatccacaccgacgtccacgcgcgctggcccaccgagcccacgcccaccaccttgcgggccgcatcctgatagcgcaaatgatcgaacacccaacggcgatcgtcgtacagggaatgccggtagctctcgaacagcgtgtctatacgtgcctgcaacgcatccaagtcggcgtaatcatccagctgattgatcggcaccagctcgggcggattggatttgaacctgagcttgccgctctcataacggcacagtttggccgccgccgcgtcgttatccttcagcagcgccttcatggccgcctcgcgcagcacacggctgcgtttggaaccggtggtctcgaagcggtcgagcgtctcctccacgtccaggtgctcgtaccacgcgtcaaggtaatccatttcggagaaccacttcatgcgtgtgcggtacgtgtgtacgcactggaccacggcggcgcgacggtccttctccttgattttgttggcgcgtccgcagatctccaccgaggcggcgagacgtttcagatcccattcccacgggccgatagcggtttcgtcgaaatcattgatatcgaacaccagacgggcggaaggggagcggaaaatgccgaaattgccgatatgcgcgtcgcccacgcactgcaccggaatgccagtgactggcgtggaagccaggtcattggtcatgatgagcacggtgccccggtagaaggtgaaggggctggcgctcatacgcttgtaacgcagcggaatcagatccggtacgcgaatcgcggactgctcctccaaaaggctgatcgcctcacgccggccctccttgaccttccagatggcatgtgcgtccagcggcgccttggtacgagtggcgatgccggcgcgcgaacggtcgcgcgggtcggtggcctgcgtccagctggtcacgtcgacgggcggattggcggatggggtgagatgatcttcgctcatagtcactaccatagtgccgtgccggcatgggcctgaaccatgcctgacatgcggaccggggcatgttgatgaaatctcgcgactcgcaggtgacgaacagtgagatgttaacgcccttcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgcgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgtgcgctcgacccggtggccaacccataccttgcctactcggtgctgctggccgccggtctcgacggtatcgataagcagatgcagctgggcgaacccaccagtgatgacgtgtgggagctcaccgacggcgaacgtcaggctatgggtattcagccgctgccgcgctcgctggacgaggcgctgaagatcatggagaaatccgatttcgtggccgacgtgctcggcgaacacgccttcggctacttcctggacaacaagcaccaggaatgggaggagtacaaccagcaggtcacgccttacgagctgaagaagtatctgccgaagctgtaatcgcaagcgttgcacatgtgccgaaccccgtcgatgattggtcatcggcggggttttctatggcgtgtcgttgtggtgggtagcgggcagaggcgggaaaagtgttatcgctgagttgatacgaaaaaacgattgacgtaaccgacgaatcagcttgtagtacgagcgagagcactcaagagagcactcaagagagcacccatgacgaacgcacctgcgaacaccgcgcgcaccggccggcacttgggtggccgatacctttggttggcgtgtcacctttgccttggtttcggtgctcaccgccgtgctgatggcatcgatggcagtgtctctgccacgtagctcgcatccggcgaagatcggtttcctgaggcaattccgcctgttcttcgaccgccgcatccagctcggtgtggcggatgtggtcttcggcgcagccgcctcctatgtcttctacacgtatctttcgccgatcatgcgcgacgaaatcggcgtgcccgaacgctatatcagcatcggcttggtgatttacggctgcgcctgcctgtggagcaacctgtacggcggcaagctggccgacaaaggtcatggcgtggaaccattgacccacattcgaccgatctactgcgtgcaggccgtctgcctgtgtctgctggcattcgcctcgctgctggcggttggcgccacgaccctgctgcgtccatacgtcgaacgctgacagtgttggccgagtccaatcggacaagaccggtcagctgccgttatcagcttcgcggcgaaccgaaccagctggtgtagataagcgcgaagttgcggttgccataactggagcaggaatcgccggtaccgttgccagcggccagtgcggcgatgttcggctggtagggcgtatagatgtagagcagggcggtcgccttgttctcgatatacacttgtgcgccgccgcatgccgcgttcggatgatattggatgtagttgagattgtgcgccgtatacccgtactgttcctcgtgctcgagatagtaacggtaccgcttggccgcgccatacacctgccgaaagaatccggcataggcgggatcgcagtcggcggtatccggacagttcaaccccatcgccgccataagctgatagtcgctgggatcgacggcagtgaccagatgctgctccttctgcatcacggtgagcagcactttctggctcaccttgcaggcgcgggccgactggtcgatgattgccgccgccgactcgcctttggtgcctgtatagtccgcgcacaggccttcgcctgactcgttcgatgtgtcgaaggtcatcgcggccagcgagccaccttgtgtgtccaaaaacgattggacttcggcctgactcatcgccgaaccgttgaagaactgaccatccgaaataatattgcccggattgaaatcgtatgttcgcgtcagttccagctgtgccgcctcggctgcgcgaacctgtgcccgccagtttgtgaaacgaaccagcccggccaccagcgctacgacaacgaccaccgccaccgtgggaatcagcaccatcttgatacgggtcggccagttcgccttacgccaggaacgcttcagagcattgatcggaccgtgcctacgattgcgtttcctgttccgattgccgaggcgtccgcgcacttgcccacgctgtgatgacggcttgcgcgtgcgctggcgcgtggcctggcgacttgtttgccgtccggtcacgccagcgctttcttgatacggttgagcgaagccggccccttggtgccaagctcctgcgcccatagggacacgtagaactcttcaagcatccaacgggcctgttcggcctgcttcatcaatgcctcatgcttcgggccggccggctccgccttggcacgggccaacgccttatcaaccacctgacgggcctcgtcggcctgccaagcccacttgacatcacggttcttatcggttttcgccttattgagtcggctcagatcggctctcaaatatcggctcaacgacttcagcgcatccgggggagtgcgcccgatgaatccggggtagacgagcgtggcgatatggtcgcgaatcgactgcaacaccgaaagcatcggcagatcagccttgccgccagtggccttgtcgacctcggcataagccttgagtacggcgatcacgtcatgcgccacctgatagacggtgtcctcgtacacttcgcgcacatcgagcaccgcattggctaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaatcgcaacgcatccaatgcgccacgccagagcatcgtggcccgggactcggtggtggcacccgccttatgcaacaggttcgcctgactgaccagcttgccctgttctccagcctgatcggcctgcttcttgaccatttgacgggccgacgcctccgcctgcgcggcgaacttgcgttgcagcgccttcagatccttggacacacccagcaccttgatggggccgcgcgcatgccggcgtccacgagggtgcttgccggccggcagttgctgctccaccgagaacgtgactctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacagacccggcacattccatgtgaactggtcgggcgtgatacgcgagagcgccttcaacggcacatgcacggtgacgccgtcggccgggtcggccggatcgtacacgtagctcagacgcaggtcgatgggttggccgtccgatccggtcgtatgccaatggtcggggtaatcgtccagactcaccgaatcgctggatgccagacgctccaccttggccgggtcgaaatcaagcagattcggctgacggtcatgctcggacttccaccatttcgccagatcggccacgctggtcacatcgttgggaatgaccgcgttgtagaagtcgaacagatcctcgtcggacacggtatccgccagctggcgggtgcggctcgcatcatcggcggcatcctcgagaatgtcgcggtttttgcccacgaagtcgtcgtaactgaaacgctgctgaatatcgccctcgaccagaccctggcgaatcaggaagtcgcgcgcctcaagtggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccaacggttcggcccacgcggggtcgatggccgccgaatagcgggcccacaggcgagaggtttccaccagttcggtgctcatcacccatgacggggtcttcttggccacggcggaagcggggaacagggcgaaacgggtgccgcgtgcgccctgataatcgttcttcgactgcttctgggcgcgtttcatcgcacgggcgcgcgccgaaccggtcagccccgcgaaatcggaggccttgggctcgcgcaccacctgcatgcccatcatcgacagcaatccggcgagcatcgacttgtggatgccgtccgcatcccacgcgcagcacagcgaatgcgcggcctgctgattcaacggcagctggcggatctccaagcctgggcgggaggcgggcagcgggtcgccgaccttgaacttcagctccttgcacatctggcgtagctgggagacgagatctttccactggcgcatcctcagccagctgaaatactcggttttgcagatacggcgcagcgcgttgttgctcgggtcgccgtctgcttggaacacgcggtcccagatattcagggccgtcaggaagtcggaggtctcatccgcataccggttgtggatgcggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacgaccggtatgggtgagcgtcacctcgccgcgcttgcggccgatggccttgagctcggtgagctcattgaaaccgtccgacacggccttcatatccggcggatcgatgaacccgaagttcgtgacgtcctcggccgtgcgggccacgcccaccgacagcatgtggagtaccacggcacccagcgaggtacgcaggatttccggctcggtgaagcgcggacgggtctcgtaatcctcacgcgaatacaggcggatcgcgatgccgtcggccacacggccgcatcggccggacctctggtcggcactggcctggctgatcggctcgatcggcagacgctgaacctttgcggtcttcgaataccgggagatacgggcggaaccggggtccaccacataccggataccgggcacggtcagcgaggtctcagccacattggtggcaatgacgatgcgctggtgaaggtgcgattcaaacaccttatgctggtcggcggcggacagtcgcgcgaacagcggcatgatctcgatggcatccggccggcgcatgtcgtcggcgcgcgggccgtaatgatgccgcagtgcggcctcgaactcgtggatgtcgcgctcgccggaggcgaagaccagaatatcgcggggaccgcgctcgtgggaggagtgaatcaccagctcggcgcaggctcgagccacggcggtaggcatatcggtgatgccgtcatcggcataggaggcaccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcgtagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtatcgggtgagtttcggatcgcgctggatctgggcgagcagaataccgtcggtcacgaccctcaatcgtgtgccgggcgagctttcgtcggtgaaacgcacctgatagccgacctcgtcaccgagcttcacgcccatctccgaggcgatacgttcggccaccgtgcgtgcggcgatacggcgaggctgggtgtgcacgatctgcttgccgtgcgtgccacggccaagctcaagcaggattttcggcagctgtgtggttttgcccgaaccggtctggccggacacaataacgacttgggaacgtttgaccgcgctggctatctcatcacgcgcggcagatacgggaagttctgcgggatactcatatttcatgacgaacttcaatgatacggaagcccttggagctcgcgtatttgctcgcagtgaacccctcgccgagcgcatcgtccagccaggggatcagcgaatcggaaccgagattcttctgcactacgagataggcggcaccgcccaccttgagcttcggcagccaagccataagcaatgtatgcagcgcttccttgccgactcggatcggtgggttcgaccaaatcacatcaaacgtgaggtcgctcggcaccgtctcgcagaacgccggctggttctcggcaggcaggggagtgctggactcgtccacctgagccgtatgaatgttcgtgtggccgttcgcctgtgcgttggcatgggtcaggtccaccgcgcgctcgttgacatccaccgcccacacgttcgcttcgggcgactcaaacgccaatgtcagggcgatagggccccagccgcagcccaaatccagaaaatcgccggtaagcggcggctcgggcgcatgcttcagcaataccgacgtaccgaggtccacgcgcgagccggagaacacgccgttcgacacctgagcggtcgcctcatggccgcgcaacgttacgttcaatgtgcggcgcacatccttcgatgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtgaaccattccaaccaaacgaggcgcacttgaccgacaacacccagtacaccgacatcaaccgcggcaacaacgacgttacccctgaaggtgtgctggccgagcagtccgaagtgttgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcattgagagagttggcggcgctcgccgaaaccgccggtgcggtggtatgcgatggtttgctgcagcatcgctccaagccggatgcagccacgtacgttggttccggcaaagccaaggagattgccggcatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgtcaggccggcggtcgcgcggccggcgcggatgcgggcatcggatcgcgaggcccgggcgagaccaaaatcgaaatggaccgtcgtgtaattcgcacgcgtatcgccagactgcgccgtcagattcgtgagatggccccggcacgtgaggtcaagcgcggttcacgccgtcgcttcggcctgcccacagtggccgtggtcggctacacgaacgccggcaaatcctcgttgaccaaccgtctgaccggttcggccgaactggtggaaaacgcgctgttcgccacattggacacggccgtgcgccgcgccaaaacccgcgacggacgcgcttacgcctacgtggacacggtcggcttcgtgcgccgcctgcccacccagctggtcgaggcgttcaaatccaccctggaagaggtggccgaggccgacgtgatcctgcatgtggtcgatggctcccaccctgacccgttctctcaggtcgacgcggtcaatgacgtgttggcggacatcgaaggcacggcctcgattccgcgtattctcgtattcaacaaggccgatcaggcggacgaggcgactcgtgaacgactcgccgcgctgcagccagatgcgttcatcgtctccgcctataccggtgagggattggacgagctgcgtaccgcggtcgaaagtctgctgccggtcccgcatgtgcatgtcaacgctctgctgccgtatgccgctggctccctgatctctcgtgtacgcgaatacggcaaggtagacaaggtggagtaccgcgatgatggcatacagcttgaagcggacgttgacgcccatcttgccgctcaggtggtcgaacagtccattgactaacgtgataaacatcacagtatattcgtgagcgctaacaaccgttgaaaacattaccatacggttatcaaacagggtggtgtgccggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccaccctcgccttcgccgctgcccagcgtggcatcgctcgcgagatcgtgcttgaagacatcgccaaggagcgcgtggaagccgaagtgctcgacatgcagcatggctccagcttctacccgaccgtgtccatcgacggttccgacgatcctgagatctgccgcgacgccgacatggtcgtcatcaccgctggtccgcgtcagaagccgggtcagtctcgtcttgagctcgttggcgctaccgtcaacatcctcaaggccatcatgccgaacctggtcaaggtggctccgaacgccatctacatgctcatcaccaacccggtcgacatcgctacccacgtggctcagaagctcaccggtctgcccgagaaccagatcttcggttccggcaccaacctggactccgctcgcctgcgcttcctgattgcccagcagaccggcgtcaacgtcaagaacgtgcacgcctacatcgccggcgagcacggcgactccgaagtcccgctgtgggagtccgccaccatcggtggcgtccccatgtgcgactggaccccgctgcccggccacgatccgctcgacgccgacaagcgcgaggagatccaccaggaagtcaagaacgccgcttacaagatcatcaacggtaagggtgccaccaactacgccatcggcatgtccggcgtcgacatcatcgaagccgtcctgcacgacaccaaccgcattctgcccgtgagctccatgctcaaggacttccacggcatctccgacatctgcatgtccgtgccgaccctcctcaaccgtcagggcgtcaacaacaccatcaacaccccggtctccgacaaggagctcgccgctctgaagcgctctgccgagacgctgaaggaaaccgccgcccagttcggcttctgataaaaaatcgctgtacggagcgcctttcgcaccgcacaagactcgacctacctttgtaggccttcaccttgtgcggcacgaaaatcgcacacgtacagcgattttttataccctgctgaatgctcccgttgggagcattttttattcgtggagttcgttggaggagggggagctatagccctcgggctcgagctggaaggtggtgtgggggaccgagaccgggaagtgctcgcgcaggcaatcctgcagttgggtgaggattgtggcggcatcttccatggtgaggtctttgtcgactaccacgtgggccatcagaatcggcatgccggtggacaccgtgctggcgtggaggtcatgcacggcaagcacatgcggcacgtcttccagatgttcgcgtaccttatcgaggtcaagtccatccggtgtttcctccagcagcaccttgaccgcgttgtgcagcaacttgatggcgcgcggaatcatcatcagtgcgatgacggcaccggccacggcgtcgaagccattccatccggtggggatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccgcgaacagcagcaagccgatatcgtcgatttccgctttggaactgccgaacagacgcatgccggcctccaccaacgcatagatgccaacgatgagcagcaccacggcacctgcggcagcggtgagcacctcaagcctggcccagccccaagtacgagtgttgttgggcttgcggcgcatcagtatggcggtgattgtggatgccgccagcacggacatgtcggtgagcatatgaccggcatccaccagcagggccaatgagccggttaagacagccgacaccacttcgatgaggaagaccgaaccggttacggtcaacgtggcaatcagcctacgctggtgcgcggcagggtttacggatgtggatgatgcgggtgcatgggtatgagccatatgtactccttcgctctatcgagttgaaaccgcttctcaataccatttgcgatatggtctgaatacgacgaaaccccggcgcgaggccggggtttcgtaagctgtgcgtgactatagcacgaccagcgcgattcggtgcacgctgatcagctggtggcgaacaggctacaatttgcgcagcacggtgaccaccttgcccataatcgtggcatgtgtgccgtcgatgggcgagtatgcggggttgtgcggcatcagccagacatggccgttttccttgcggaaggtcttcaccgtggcctcgtcgtccagcagagcggcgacgatatctccgttgacggcggaattctgttcgcgcaccaccacatagtcgccatcgcagatagcggcatccaccatggaatcgccgtggacttccagcatgaacagggtgccggagccggtcagccgttccggcagacgcatgacgtcgtccacatgctgttcggcggtaattggcacaccggcggcaatacggccaacgagcggcacatcgtgtgattcggcaatggcttcggcggggaattggtatatctccgccacattactggtgctggttgcctcttcgctggcttgggagggcttttcggcattcggggcggatcctgccaccacctcgatggctcgacccttgttcgcgttcatgcggatgaagcccttgtcttccaaaacttgtagctgatgcttgaccgaagacggacttttgagcccggcggcatttccgatttcccggaaagagggggcgaagccttgttcgtcgatatgcgtgcgaatggcgtccaacactttgcgctggcggtcggtcagggtggactcgtccggcttctgcttgggggagaagggaatggtgctcacgtcagggctcctttcgttacgtcaccagcataacgtgttgttcgtgtgaaatcaaacatctgttcgagtttcgacttgaccgtgtcgaacgtttgtgccattataagaacagttgttcgatagaacatctgttcgagagaggtggtcgtgatgactggttcaatggtgatggccccggcccgtagcgcacgtgtagctatgcagcatgctggcgcgttccaccggaatgtgcgtgggaagattatcgcagtgatggtcgccttggcgctggcctggtgtggtttcggcgcgcttaccgctcagcgggcccaatcggatacgggggccacgcaggtgaccagttatatcgtgcggccgggggatacgctctggtcatatgcttcggctatcacgcctgctggtcatgatgtatcggaaacggtggatgagctgattgcgttgaacaatcttgagtccggatcattgcaggccgggcagcgcattattgttccggttgagtaaatgaaacccgagcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcagcaagcgttttaccacggtggaaaccagtatgctgctggtcactaaacgttcgggtggcgtggagccattcagtagagacaaagtgatttccggcgtacgcaaagcttgtcaggggcggccggtcagagaagaggatctgaagctgctgggacagaaagtcgaagaggatcttcgctcccgaggccttgccgaagtcacctcagatgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatatgcgaatgccatgcaccgtgatatgcgagtgattcgcaaaccatggtgcgagccaatcatgaagcccagcacttatgaaagagacccgtcatgatgacgggtctctttcatatcaatcgaggatgagctgcgtcagctgatgacacgcatgcgaatggtgccttcgatgttgcgcagtgcttcaagcgtggcggcgctgggcgtctgagccacgtcggtgaccacatagccaagttcgccttcggttgccagcgactggaaggaaacgttgatgttctcctcgccgagcacatgattgacatgagccagcacaccaggaagattgtcgtgcagatgggcgatacggcacacacccttgcactcaccgaggttgatctgtggtaggttcacggacaaggaggtagaacccttgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaatccggtgttcgacttgcggccatccacgtgcagggtcacggcatcggactgttccagcagttcgttgagggtgtcgcaacggtgggcattgcccagtgccagtttctcctcaatgtcgtagaacaccacgcgcatgccgagggcctcggccagtaccgacagctgggagccgatgttgccgtagccgatgatgccgagggtcttgcctcgcacttcatgcgagccggaagcggacttgtcccacaggccatgcttgatgtgatgcgtgtgtgcgggaatgcggcgcatcaagcagatgatgtcgcagatcaccaattccaccacggaacgggtgttggagtagggagcgttgaacacggcgatgccacgcttgccggcatgtgccagatcgacctgattggtgccgatgcagaagcagccgatggcgcttagcgtaggacgcgcatccagcacgcgggctgtgacgttggtcttggagcgtacgcccaccaagtccacgccatccagcgcatcgatgagttcgtcctcgctcagggctcccttcatggtctcgacttcgaaaccgtgatcacgcagcgatttggccgcatcggggtgaatgttttccaataacagtgctttgggcatgcttcataccttagatgttcagggacttttcgtccgcttttgtccgaactataaccagtttctgggtcggcctggtcattgccacgtacaggtccgaggcggcgaccaggcggctcggcgcgtcatcctcgatgagaccgggctcgaccaccacgacggcatcgaactccagacccttgaccgtttcagtgccgcagacgctgatttgctcatcccattcgggctgctcgatgagccttgcgtattcggccgggtcaagaatgacagccagtttgcggcgcacggcatcgcgcaccggggcgatgagattatccggacagatgacggcgatgcggccggtgccgtctgccgaaacgaattgttcggcaagctgcgccgcctgctcggccgtcgtttccagcaaggacgacatgtcgggcaccacattgcgggacaccgaatcggggatggtgcgcaccgcattgaccgtggagatgtagaggccttcctcctcggcaaatcgtgaggcaagttcggaaacttcctgcggattacggtagttgatggtcaactcgttcaaatcccagtggctttcgccgaacaggcggttcatcgatttgctccagcgtcgggtgccacccagcgccgaagtctgcgccacatcgcccacgatggtgaacgagcgggaggggcaacggcggatcaacatacgccagtccatggcggtcaattcctgcgcttcatcgaccacgatgtgcccgtaggtccattcacgatcggccgcggcccgctgcgcggtcagctcagcgtcgtccccgttcatctggtcgagcagcatctgactggagacgatgcctccacccagaccggtcgcggccagagtgtctttggcatactgctcttcggcggcacgacgtgcgtcggcggcggactggcgggccaccgccttgggatcggggcccagcatatccattgcttcgtcgagcagcggaatatcggagcgggtcaacggggagcctttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgaacctgctcgttcatacgtagcagcgacatcgcgcggttcagctccgcctgatccggcgtgtaatcaagctgttcggcataacggttctgcatgctggtcagcatcgaacggataaaggtctcgcgggccttgttatgaggttgtcgggtgcgcttcgcgtccgcctgcgcctgctcgatatcagtggccagcattggtacctgaatgccgctaatggttactgtcggcagagcagcgggaacacgcacgcgtgcggcgatggcattggccactacggaggtcatgcgtcgatcgcccttgagcttggctgcataaggggagtcgaccgccgtggcggtgatgccgggaatcagatcgctgatggtgcgtgagaccacgccggtctcgcccaaggagggtagcacctgatcgatgtagtgcaggaacgccgagctggggccaacaaccagcacgccggaacgttccagcgtgcgccggtgcgtgtacagcaggtaggcggcgcgatggagcgccacggccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcttggccgacctggtctgaatgcacgtcgagcacctcatcctcaacgcccacgacttcgcggaaactcaaggtgatatgcctgcgcatcacgatgtcgccgtgattggaaggggtcgcctcatagaaaggacgtgcggcttcggcacgccagtcggtcagaatcggctcatggtccgggctcgacaggccgatgcggccgatgtaatgacggtcgccgttcttggcatcgaggcggccaaacaccagccgatcctcaacgctgcgcaattgcgtgaggcggttttcgtacattgcggcaaaggagtctcgttcgctgcgttgcgtgggggatccgtgggagccggcggcgcgtacggtgtccaggcgttgccacatttcggctcgcagatcatccaatcgtccataggcgcgatcgacggcctgctgctcttcatgcagctgggaggcgtaactcgacatgctgttctcttcgttccatttccgtggggcagaaaaacttaaggcattcaaatttaccgcacaccccctacgtcagtgatgcggacaacccggaataggtgaattcagcgtgaattcaccatgctgctcggtcggtggggtgcgcgacgtggattagatgtgcggagcgtccattcgtgcgacagtcgtggccgacacgcgcaatccatcggtaattgccctaaaagggtgagcaaatcgtgcatgagtggggagaaatggggaatcgtggggtagagtggtgagccagttggccgaagtgtatcccacgtaacgatgaaggaggtggagccatggttgccgatcagacgattcgcgacgttgatgccaacgcacaaggctccaccactatggccgatctcatggctggtctgccgccattgcttctcggcacatatacgccgaagatcgatgccaagggccgtatggcgcttccggccaaattccgctcccagctggggcagggcctggtcatggcccgaggccaggaacggtgcgtgtacctgctgccgttcgacgaatttcgacgtatcgcctcgcagattcagcgtgtgtcggtgggaaacaaagccgcccgcgaatacctgcgtgtgttcctttccggtgccgtcgaccagcagccggacaagcagggccgcgtgctggtgccgcagatgctgcgcgattacgccaatctgggttccgacgtcgtggtgatcggcgttggcacccgtgccgaactgtggaataaggacacgtgggagtcctacctcgccgagaaggaagagggatattccgatattgctgacgatgtgttgccggaggtggaattctgatggttgatgtggcgaatattcatctgccggtattgcttgacgattgcgtgaacctgatggcacctgccctggaacatgagaacgccatcgcagtggattgcaccctgggccttgccggccattccatcgccttcctcaaggccgcgcctcaggctcggctcatcggcattgaccgtgacagtgaagcgctggggctggccaccgaacgtatggaacgggaggggctcgccgatcgattcattccggtgcatgccgccttcgatcagctcgatcaggtgttggcggaccaagacatcgaacgcgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcgtcgagacaaggagccgtttaccaccaccgcacagctcaaccgtctggtcgatgaagtggtgccgcaagcccaccgcccggcgggcaatcccgccaaacgcgtcttccaggcgttgcgcattgaagtcaacggcgaattggacaagctcgcctccacattgccgcaggccgcgaaccgactgcatgtcgggggacgactggtggtggagtcctatcattcgctcgaagacaaaaccgtcaaatcgttcatggcacaagggctgcgagtggatgttccggctggcctgcctgtcataccgccggatgcccaaccgtttttcacggatctcacgcgaggtgccatcaaggccgacgaacatgaaatcgcagccaacccgagatcggcttcggtgcggttgcgggcggtggaagtcagccgtgagattccgtcacgatggaggaaacgctttacgcaaaccgcgcagggcctgaatgacgtcaagatacaaggctccgcgtctccgggcagagccaaaaacacggcacgaattcgtacaaggaggggatgacagcatatggcaactgcacgtagcattcgatcgaacgcggctccagcctcgaaccgaccgcacaccaagcatcagtcctcctcccgacctgagctgcgggtggtctccaacccgcgtggaaacgagcagggcaatgtcgtcggacgggtcatcgaatggaccagaacaagaagcgcaccgctggtgcacgtggccattgcagtgatcttcctcgtcggcaccttgttcggcgcgctgatgctgcgtacccagatggtgcagaactcgtttgaggcggcacagatcgaaaccaacatcaacagacttacccaagatatcgaagacgatcaggccaaactcgatcaattggtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcatcgccatcggcgccgcattggcgttggtggcgtcggcatgcgtgattcagctggcctccacccagctcatcggcggccgtcaaaccgcacaagcggccacggctaaccgcaccctgaccgtgacgttgagcgccaaacgtgggcgtatcctcgacgccaacggctccgtgctcgctcaaagcgtggagcgttatactatcgtcgccaatccggaggctgcacaggagttcgagccgattacttgcaatgacaacacccgtgattactgccacgaaattgacggcaaacccgtgggcgctaccggagcggcggccgtgggccgactgctggccaaagtcctggatatgaacgccatggaactgggcgctgatctgtccggtaccgggcagtatgtgattctgaagaaagatgtgactccgcaggtcaagcgcagcatcgagtcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggtcttgaaggaggccgaatccaagtatggtgcagcgtgggcgatcgccgtggtgcaggatgtccagagcggggagattctcgcactggccgatagcgatgaagtacaggctggtaccgatgcggcgaagatgagcccgtctcgggccgtgtccgaaaccttcgagcctggttcggtgggcaaggtcatctccatgtccggctatctgcagatgggactgcataagatgagcgatcaattgtcggtcccggaccacatcacacaggagggccagacctacaaggactcattcgaccatggcactgagcgctggacgctcgccggcattctgcagaactcatcgaacgtcggcatgattatggccggggagaactatccggatgagcaacgctacgagtacctgaccaaattcggcatcggacaaccgaccggactgaacctgcccggtgaatcgagcggtctgctcaccaacccttcggcgtgggatctgcgtacgcgcaacaccatcctgtttggtcagggctacaccgtcaacgccctgcagctcaacaacgtggtggccaccatcgcgaacaagggtgtcaagcagcagcagtcgatcatcaaatcaaccaccgatgccaatggcaagaccactgagaccaagaagggcgaagccacccgcgtggtggatgaaaaggtcgcatcggacatgatgaatgcgatggaatcagtggcggaaggctacaacaagttcgtcaaggtcgatggttaccgcatggccgccaagtccggtaccgcagaggtgcagggctcggatggtacgctctcgtccattatctccgattattccgtggtgattcccgcggacaacccgcgctatgcggtcaccgtggtgatgaaggatccgaatggtgtgttcggcgggctgacggccggccctgtttccgcacagatttgtgagttccttatgcagaaatacgaggtgcctgtctccagtccacgcaaaaatgctattccagtcacgtggtaaggatcaggggagaaaggcgatagcccatgagtgcagtgagcgaatccatcgcccagcgggtgaccctgggaatgctggtcgaacggtacggttttgaagtcgatccacccttcgccaccaatgtcaccattacctcactcagcgatgccgtggacaccgtgattcccggctcgctgttcatctgcacgcatgagcaggaacccgatgtactgcatgccgcacaggccggtgcctatgcggcgttgctgccacgcgcgtccaaagggcagatcgccaatgccgatataccgttgctctacggcgatttcgacgatcgcgtactcggcgatctggccagcggtctggccggcggaccgtccaatgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacgttggccgagcatgcgttggaatcggtgaacgtggatgtactgggcacggaggatgtcaacgcaagcgcaagcttgaacgaattgaagacacgctacgcattcgttgcggaacatgacatgtccatgacctcgtcgacacccgaatcggatgaaatggctgcggattcaccggcaatgtatgaccgcgtccgactcgggcacatgtccttggccatcgccatggtgctggccgccggcgtgaggaaaaacaacatacgcagtgccctgcatgtggccaataatctcaattaagtccgtggatacgggacgaagcgtaatcgtaaaggagtttgaaacaccatggttccgatgagcgtggaggagatcgccaaggccgtcgatggtcgattgatcggagacgccggttccgagtctcgagccaccaatacggtcagcgactcgcggcaggccggccccggatcggtgtttgtggccatccgaggcgagcgtgtcgatgggcatgactttgtggcgaaaaccgctggacagggagccacggtggccatcgtcgaccatgaggtgaagtccgatggccttccgcagatcgtagtgaaagacacggtcgacgcccttggcgaactcgcccgatacaacatcgttcgccgccgcgagctggacggcgacttcgacatcatcggattgaccggttcggtgggcaagaccaccaccaaggatctgctctcctccctgcttgccaccgtaggtccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgagatcgtgcagggattgcttcccggaggcaccgcggtactgaacgccgatgacgaacacgtggttcccatggccggcctggccaacggcgacgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaatgtgatgaacgcgttggccgccgcaaccgtggcgatgcgttacggtatggcacccgaaacggtggcacggattctggcctcgcagcacaccatcagccctcatcgcatggcattgtccacggtgaatcgcgaggggacttccttcacgctgatcgatgattccttcaacgccaatcccgactccatgaaagccggcctgaacgggttgaaggcctggaactcaaatgacggcaaggagccgttccgcgtggcgctgctgggtgccatgctggaactcggcgccgatgaaacggcattgcacacctcgatcggcacgtatgcggacgaattgggcatcgacgcgatcatcgcggtcggttccgcccaagaccaacatctcgatgcactggcacaggctctggcggacggtgcccgtcagagccaatccgcgtcggtggattgcgtacacgacatcgatgcggccgaacagctggtcatcgacttggctcgcaaccatcccgacgctgtggtactgctcaagggatcgcacgcgtcaggcctgagcgctttggctgaacgctgggcaaagaactgaccttataaccaccccaagaaaccgacaagaaagagaagctgcacgtgattgctctgatcattggaatgctggtgtcgctcatcgtcaccttagtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcgggcgacgtgccctcctggtccgcggcgctcgtactgttcgccatgctgtcgatgggtctgctgggctttatcgacgacttcgccaaggtgcgtaagaagcagaacgaaggcctatcggtgggcggcaagttcatcggccagttcatcttcgccaccatctacgcggtacttgcgctgctgattcccaccaaatcgggattccccagtgcgcaggcaggcatcagcttcatcgaacagccgttcttcaacttcgacttcgccggccgtgccgtagccatcatcctgttcgtcatctgggtgaacttcctgatgaccgcatggaccaacgcagtgaatttgacggatggacttgacggtctggcggcaggttcgtcgatgatcgccttcactggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcctgtggtacaactcgaaccccgcatcgattttcatgggtgataccggttccctggccttgggtggtctgttcgcagccctgtccatcgccacgcacaccgaattcctggcggtggttctgggcggactgtacgtcatggaagccatgagcgacgtcatccaggtcgggtacttcaagatgacccacaaacgtgtattcaaaatggcgccgattcaccatcatttcgaactggagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtgtccggcacctcgttggcggaggtattgagggaacgcggtgcccacgtgattggcgtcgacgagaggaagcccgaggccgatctccactcctttgatgacgtggactgggaccatgtggactacgtcatgtcgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatcctcagcacgacgtactgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacgcgccatcgtctacaatgcgcaggacgccaaagtcagcgaactggcggccgaggctcagactgccgaaggatgccgcaaggtaggattcacgctcgaggcccctcaggccggccagatcggcattgaagatggctggatcgtggacaggagcggcgtggccggcggcgcagtgggagagtcggtcagactggccgccatcaccgatttcacgcatctggcagagccggacggctcactgtacccgcatctggtggccgatgcattgacggcattggcgttggtgctgggacttggcgctgatcgcgataccgcgctgaaggcgcttacctcgttcaagccgggcggccatcgcatcgaaaccgtggctgaggccgcagtcgagggcggctctgttcgttttgtggacgattccaaagccaccaacggtcatgcggcacgcgcctcgctgtccagcttcccggccaagtctgtgatctggatcgccggaggtctggccaaaggcagtcgattcgaggacctggtcaaggaccaggcacacaccatcaaagcggccgtcatcatcggcaaagaccagcagccgatgatcgaagcgtttgccagccaagctccggacatcccggtgaccatcatcgatcccgaagacaacgataccgtcatggaccgtgccgtcgaagcctgcggcacgtatgccgccgccggcgacatcgtgcttatggctccggcctgcgcctccatggaccagttcaagtcctatgcggatcgaggcaatcgattcgccgccgcagccaagacgtggagcgaggtgcatggcctccactgatacccataagcgtaaggcatacagagcccctgacaagccctcactcgaaatcgccgactacacgggttggcgaagcttgctcaacccgctatggtgctaccacggcttccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgatgatgccggtgacgttctggaaacggaccggcgtgttctttgtggtgggtgcctgcctgttgcaggcgctgacctttactcctttgggtcacgacgtctacggcaacagaggttggctggacctcggcttcaccactatccagccggccgaattcatgaagttcgcgatgtgcatatggcttccctcgtcgttgcatgcctgcagcaagatgtaccacaagaagggaatcaaagcatatgccgcgccgttggcgctgtatgcgataggcgtggcactggtgatgggcggcagggacctcggcacggccatgattctggtcttcatcggaggcgtggcctttctgatcgtcgggttccccggcaaatggatgggagtcggcgtattgggcgcggtggttatggtcggtgcattggcggtttccagcccgaaccgcttgcgtcgtattctggccacatatggcgattgctcggccgctgacgcgcagagcgtatgctaccagtccattcacgccaagtacgccatcgcctccggaggttttctgggattgggcatcggcaattcgcgggagaaatggaattacctgccggccgcccataacgatttcattttcgcgatcatcggcgaggagaccggattcgtcggttgcgccatcgtattgctgttcttcgcgattctcgcctggtgcatgatcgtcatcgcattgcaggtcaccgatcgttatgttgccatggtgctgatgtgcgtcaccatttggatcgtgggccaggccatggtcaacatcggcgtggtcgtgggtgtgttcccggtattgggcgtgcctatgccgttcgtctccgcaggcggctcatccatggttatgtgcttgacggcggccggactggttgtgggacttatgcgctctcaaccgcagataaaacagtcgcgtcagagcgcgtaagtagactcggtaatcatgaatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggatttggtgccggaggccggctacgagctcgacaccatcgaaaaagtgccgttcccgcgtcgccctaacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacacaagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcatcggtgacgaccgtgccgccgtacgccgtgaatcggccgcgcagcttggcgtcgatccgaaccgtccgctggtgctggtcactggcggatcgctgggagcgcaaagcctgaaccgtgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatctggcctttgcctgtgccgacttggtgatttgccgtgccggagccggatcggtatccgagctggctgcactgggcctgccggccatttacgtgccgctgcccatcggcaacggcgagcagcgtttcaacgccgagccagtggtgaacgccggcggcggccttctggtcgcagacaaggacctgaccccgcagtgggtgcatgagcatgtgcccgatctgctcgccgatcacgaacgacttgccgaattcggccgcaaggcatgggaatacggcatcagaaacgctgccgaaatcatggcccggcacgttctgcaattagccgaaccatccaagtagtattcagatatcattccgtgcgcgatactgaccaattccgttccgcagcacgagatacggtcataatatagggtgctggaatccctaaaggagttttgaattgtctcaagatcagcccatagtgcttgaccctacgtatgcctcattcgatgctgcggcccgccctgcggatctcggcgccacccatttcatcggtatcggcggtgccggtatgagcgttctggccgaaatgctgcacgccgaaggagtcgcggtggacggctccgatcgcgcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcacacgcggcgggcaagcgcattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccatcggcggctttatccaaggcccggacggaaccacgctggacggcggacacgcgggcaaaggcgacatcctggtggccgaagccgacgaatcggacggcagcttcgccaaataccatccgaccatcgccattatcaccaactgtgaagccgatcatctcgaccattacggcgacgaagcccactaccgtgccgcgttcgttgcccacgccggccgggccaccggtcacgtgatcatcagtatcgacgactccgacggacttgccgtgctggaggccatgcccgccgacgtgaaatcccataccgttgcctacggcactaccgcgcgtgaatccctgcccgatttgggcggtgccgcgtatgtctggatcgcttcggaaagcgagaccgcaggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaaggcggccggcacattcctcggtgcggcacgccgcttccaggtgcgtggcacggtcaagcaggtcactgtagtggacgattacgcccaccatcccaccgaaatcgcggccctgctggatgcggcccgacgccggtaccccgattcgaccattcgtgtgatcttccagccacacctgttctcccgcaccaagttcttcgcgcaccagttcgccaaatccttagccaaagccgatgacgtcattatcaccggcatcttcccggcccgtgaaaagcaggccgatttcccggacatcagcccctccaccatcgtggacgcggctgcgggactcaaggatgcttccgcaggcacgtggattcagccggtcgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtccggaagtccccgcaagccgcgcaccatcggttcacgcggaaacacgggtcactcgtcgaagtctcgcgctccccggtccgtgtcttccgggcatgagatcgacgagccggagatcatcgacgatgtgacggtagccaagggccaggccggtgccttcgtcgatgcacgacggttgcgcagcgaggattacgttgccgaaacgctgcaccagaccaccggctccctaggagtcgtatcacgcccgaaagtggtgaatttcaccgaacgcgccaaagaacgcaagcgtgcgaacgtacgcgtcgtcgcgttacgcgtgttgattgcggtcgtgagtgtggctgtagtgacggggctaacgtggctgctgctcttctcgtcggtgtttcgtctggaaaccagcgagatcggcgtatccggtgccaacgaatgggtgagcgcgcagaccatccatgccatcgccgataagcaggctggaaagtcgttgttcctggtctccgcccatgaggtcacagagcaactcaagtccattcccggcgtcagcgaggccaaggtctccaaacagttccccaagtcgatgagcgtggaagtcaaggcgcaacggcccgcggccatgctgaaaagaggcgataccctgaccgcggtggattcccaggcgcgtgtgttgaactcggtgaagaacgccaacgtggatggcatcccggtgatcgaggtcaaggatatagacgccagtctcaagaaccgttcggtgaaggagacgctgacgattctgggcgcgttgccggaatcgatgcgtaagtccattaccaaggtcaccgctgagacgcaggattcggtgactaccacgcttaacgacggtgaccgcgtaatcatttggggcgactcctcgcaactgaagctgaagttggcggaagtcgaggaaatcgacaagaacatcaccgctggcacggctggctttgccgggaaacatcagattgatgtttcctcatcccagaagcccatcatcaagtgacggcgatttcgttggcttcgttggttccgttggttccggggcgatgttcgctgctggcgatttgcgcgagtagcgccatagggtgtatgctgaaaagtccggccgaaaagccggaagcttgataactcaagattgggggcgatcggtttcgacggtgacctgttcgctgcagggaagcgtgccgagaacgccgggtccgctcgtggatgaccccggcaaaagaataagtgctaaatctaaccgcactgagttcgctctcgctgcctgatttttagtcaggattaaccagtgagcagccgctccgttcactcctcctcgtctttgggaggatgctgagcgtcgtttagaagacttgctgatgcagttgagcctcagggctgcatcgggactttaactgcggatatgctcgccatcagttgtctgcgacatcgatgggggcagaaaaatcgccaacttggccagcagactacgcacgtagaagactgtgggctcggtcatcggaccggggttcaattccccgcgcctccaccaatccgcttcggcggaaacaagccgcttggctttacgaaagtaaggctgagcggcttttcttattcccgtcgattccctcgtattctctcggtttcacgggataatgtgggcaaaatgtgggcaaaaatcgagcccgcgaagccctctgccacaacgcgagaacggccccgaccggcaagtaggccgactcgggttgagtcgtctgcgatgccggacggggccgaactgtgcgtggtggtcatgcggcgaggtcgaggcgctgtttgatggcgctgacgccgatgagcgcgccggcgaggatgccgagcgcgttgagacatgctgttctcccgcactcaggaagccaaccagatgcacaccgtgctggcagggcgcgccagtgtgtcgctgagcaggattcgccgtgatcatccggagattctggccgcggccaagccgattctggtggccgcgccgggtacgctcgccgcactcaccgagccgggtgtgctggctgatgtggcgattctcgatgcgtgcgcgcacattcccgctatcgagttgctgtccatcatcggccgcgtgcagcaggtggtggtgatcgcccactgcgcgacggtaaccagcgaaagcgtcaagcagctgatcgacacgttgcctcatatcgaggtggatgctgccccatctcgccgtgcgccgcgcctgtccgcattccttgaatccgagggatatggtcctgttcgctatgatgtggccaccgagccggctgccggtgaggtgcgattccaccgtgtggaagcgagcggtgtgccggttatgtcttctggtctggtggaatccagccagccggagattgatgaagtggtgcgtctgattacgcaacgtgccgccggttttgccgtggttccttccagctatcgacttgtggtcgtgatgttgaccgacgcattccgcacacgcttgggtgccgaattgaagtcgttggcaggcaaatccaaggcgatgggccgattcctgcgccatgtgcggttggtttccttgcgtgacgtggccggaggtcgtgccactgacgtgattctgtcgatgtgctatgcgaaaaccacgcacggacgtctgcttcagcagttcggcccgctcgaaagcacaggcggtcgcggactgttgctggatgccctggcattggcggaccacagcttggatattgtgtcggcctttggttccgaagatttggacgaagaacgactgcaccagtccggtcctcggttcctgaagaccatgttgacgtgggccgaacagcttgacgaccgtccggtgcttccgttgcgtgatgcggcaggcggcaacgtgctgttcgacgatatcgccgacaggttgcgcgcgcgaggactgaacgctgctgttgattatggattcgacaagggcgtgaagattccgctcgtggtgggattgaaggacaagccgtttgccttggccgtgcagaccgatgacgcgaactttatgtccgtgcaatccacgcgtaggcgtcatcgtttgtcggcacaggatctcatttccttgggctggaatgtgatgaccgtctggagtgtcgccgccttcgtgaaccccgataaggaagtcgaccgtatcgtcagccgtatcggtgagatctatcgcgaggttgaataaccatggcggaatactcggctacacggcgcacaccgcgcaagcacaagcgcgtggtgatgaagggcactgagcagtttgacgctgacggtgtcaaactcgagcccggagacatgcagaccgaccaacaacggcaatccgacgacgacaaacgcatcctcggcgaactgccgccgcattgggccgtttttaacgagcgcgagtaggagttggggcgcactctgtgcgccccaacactgtgttttccgcagccgacaggctgcggaaaacacagtatcggccgaaggccgattccgcttcctaccgcacaacggccataatcgctccggcctgttgcagctccataaccttggccgcggcctccggcggcattgcgaacgacaccagtcggtcgttgcttcccaatgcgccagtcgtatccggtttgtcgacattcatcaccgtggcgttctcggccagcgtgcaatcggcaccttcgcaaccgacggcggaaaccagtctcacctgatcgccggccaatacatcgtcgacgctactggccaagcggacttcaatcaccgtagtgccggtcggtgctacgggcgcatctctggccatatgcgtggaaatgggatcggctgcttcgatatcgatttgcgccaccttgcccaccacatcctcaatattgcacgcccaagacgggcctatcgcagataccggcatatcagccaactgaacgtcggcggccagaataatgtcaccccgtcgaatcgagcgagcggccaccaccatcggctcggtctccaccacggccaatacggcttcaagcccaaacaacactgcgagtcccacgcacaacgcagcagtgagtcggcgcaaggcatccgccatgcgccgtcgccgcaatgagccgcgcgcaggcggcttaataaacgaaaaggtcaccatgcaaccatggtgacctgaagtttttcgtaagcgcaagctgaatcgacctatgtggttctagcttgccaagttatccacaacgcttcaaacccgtgtaacagacagtgcccgtagtgccaatatccgcggcataccgccgtcgacaccgtcgtttacagaggaaaaacggggagccgaccttacttgccggatttgtcggtgcggtagaatccgtgacccttgaactcaatcggcacggcggaatacaccttgcgcacctgctcctgcgagcacttggggcacacggtaatcgggtcgtcattgaacgactgctgttcggtgaagtcatagccgcagttcttgcaacggtaatgataggtaggcaacggattcctccaacaaagtcatatttctcgcgcatggcgtgcaacaccatgccgtgcaaccgttcatatcctagtcgccgccctgacacattggcgttacggtcttactagccagcctgcttttgccactctggttccatcggccagtgtgcgtggctggttggtcagtctggcttgcgccgagtatcttggccggccggtcaactcagccggcccgattcgccaagccgccggtatccccccggcgtcagcactccgtcggccggcacatcatgtggttcggccggcaaatcggtgtccaacacctcccacggccagcacaccgcaatcagggggcacgcgggcttgcgtcgagccaaggcccggtcataccagccggctccacgccccagacgattgccttgcgggtccactgccaaagccggggcgatgaccagatcggccttctccaacgcttcgggcggtagaactgcgccagttggctcatcgggtctgtgatggacggtgctgggatagctgcagctaccggcattgttcgcgccacccactgcatccatcgagcgcaaggattccaatgaatccagcacactccagccaatttccaacccagatcccaatcgtggcaccaacacgtggcagccatgagccaacagccatcgcaacagtggccgggtttcgatttccgaacccatcgacacatatgccgccactgtggaaccatcctgaatcatgtgtgccgggaaccgtcgcaccagcaattcaccggccgctccacgttcttccgctggaatgcgcttgcgccgagacagtatatggtggcgcagcgtcgctttatccatcttttctgttttctccgtgccgctgtggtcgctgccgatattcatgccattgtccgcttcgctcataccgcacaatctagtgtttccaccgtaaaacgaaagtggccgaggcgaaggcgcaagcccttcatatggctacaataaaggccgtgtcagttttccagtcgattaaagaggcgttcaagctggaccaccagatccgtccgccgcgcctcacccatcccggtttcccgataatcctgcgccccctgaccatggacgatgaggacggctggaacgaagtgcgctggcgcaacaacgactggctggcgccttgggaatccggcgacccgatgcatggcggctccatcaccttcaatcaatgggtgcagcgacagcgccgtaatgagcagcatggcgtcggcgtgattttcgccatcgaataccagatgcgtatcgtcggccagatttcgttgggagccatcgcgtatggtgccatgcgcaccggtgtggtcggatattgggtcgaccaacggtacgccggccacggatttgcgccgatggcactggccatgcttgccgattgggcactcggagacccattcgggcccgcgttgcatcggctggaaatcgccattcttccggataacgcgcgctctttggctgtagtgcgtaaggtcggagcccatcatgagggactgcgcgagcggtatatgtatgtcaatggccagtggcgcgaccacgtaacatttgcgctgttggctgaagatatggggcaagggttctctgccagactcgccgccaccggttccagataagcgtcgaccggaagaattccgctccgacacgcccggacggaaagccccagttcgtcggtacgtctcctatccttgactctatgggttatgagtcactgagcactgtcgtcgtgctggtgattgtggcgattattatcgttgtatggctgcccgtacgtacggccaacggcatgaaacgtgtggacgagcaccggcaggatcgttattcgccttccctgcatatcgttgatgcagagaacggcagacgattcggagacatcaagccgcataaggcgaaaggggcagcaatgccagcatcaacaccgtcagcgaggctgacatctgagcacatcgcccatgtgcgggaactgcgccgcgcggccatccgccgccggcagattctcgccgtatgcctgcttgccataaccgtgttggtgtttgccgtatcgttccccctgcatttcagtccgctgcttgctcttattccgttcgtgctgttgctgctggtgctggtgctgggagccaatgcctcacgccaggcccggcaatgggagcgcaaggtggtccgctacgagcgggctcatagcggtacgggctggtccaagaaaccgtctgccgagtccaaggacagcaagcgtgtgaacaaggccgaaccggttgcggccgtaactgcgcctgccgagaagcctgccgagcagattgaggatgctgccaccgaggtcatggaacagcggcagattcgccgcgcgttacgcgatgccgagattgagcaggccaaggccaaggcgttgcgtcagtccgccgccgcatatcaggccgcggaagagcacgccaaacagtctgagaagtctgatattgcacagtccgccgccgataagcctgccgccgagccgtctgctatggtcgatgaatccgccgaccgtaagtccgctgccgaaaccagcgaatcttccgccacacctgatgcctccgttcgcacagacaagtcgattgagtcggacaagtccgtcgcccctcgagttgaaccatcgcttacggtgcgtgacgagcgcgatgagcgcgacgatgccgctgccgctgccgatgccacgtcggaactggtcagcgtacgccctgcccgagcactggacgtcttcgatatgtccacctcgcaggatctcatctccttcactttgggtggggaacataacgccgacaacgctccggaaagcttggagatcaagtcgacccgtcaggtgtccaaggcggaacctgtcgaacccgcagtggcggaaaagttgattgacgaggcccgagccgtcaaggccgcggacgacgccaaggctgtcagcgccggaaacgctgtagacactgagccggagcagcgcgatgatgccgatacggacgccgatgacgaggctgcaaacgccgcccagcgagccgcattccacgaatccgaggagcgtgccgacgtcgaagcgccagcggcgaccaccgattcgttgggcgcaggcctggactccattcttgcccgccgcggcaactgagcgttgcgattcgacgattttctctcacagcgttagcactcgagttggcagagtgctaataatcgcgctacgatgtgtcctagcgcaaagggacaacgcaagtgatcgtcagcctcttgaggcgttctggcgcggcattatcgaactacaagtagatacgaggtgacccacagtgtcgattaagctcacaccgttggaagacaagatcatcgtcaagcaggccgaggcccagacccagaccgcttccggtctgtacattccggacaacgccaaggagaagccgcagcagggtgaagtcctggccgttggcccgggccgtcgtgacgacaagggcgagcgcatcccgatggatgtcaaggtcggcgacaaggtgctgtactccaagtacggcggcaccgaagtccactacgagggtgaggactacctcatcgtcggcgcgcgcgacattctcgccatcctcggctgattagtcgcctagcgaacttcaacaaccccgactgttcccacggacagtcggggttttctcttgccaggcggaaaggggctcccctcagagaggggagccgaaaaccgctcccgccaaacgcccagccatgcctgctatgcataaaggtgcatgcgcgcaacgtagttgagttcggcgttgcaccgcatctacactgggtaacggattggggtccctatggaagaggctcagtcggcgacttggccgagcggcttaagacattttgcacaagacggcagtaggtcgacggtatgttgttttttccgtgtcgcaggttcgtggtgtcgtcgcgctgtgccaatggttgtctctctaccgacgctgagtgccgtggcctgaggccagcgtcggcagtgggccacgaaatggcgatgtgccgatgctgagccgcgttggtgtcgttatcgggccagtttttggaccattgccaacggcaaatcggcgttctgtgtcggcgacggtccaaaaactggcggtctgccgacgataagtgccgtcatcgtcggcagaccaccaggtattgtccttgtgccgacgtaaaagccctgccatcgtcgtcaccgagccatcttgtgactcactgacggcggcagcagggcggaagaggccgaaatcatgcgcgcggtgcggtctcacacctcgaatccggcctccgccagcgcgtgatcgatgtcgcgaatcaaatcgtccgtatcctccagacccacggccagacggaagaagccgcggtggaactcaggcgggtacaggtactggcgctcgtcatcctcaccgaggaacacgatcagcgattggtcatggccgagcgagacggcagacgtaatcacattgagcttggaaacgaatcggttgtgcccgtcgtggtcggtgtcgaggccgaacgacagcacgccgccgaacccggagtccgggcgggccagctggctggccgccacctcgtggtgcaggtgcgattccagaccggggtacgccacgaaacgcaccacatccagcgattcgagatgcttggcaatcgccaaggccgaggcgtcgtagggcagcgcgtaggcgttcgccagcgtgatggggcgacggatcgcgccggtttcggcgtcgaccccgttaccggggtgaatggccagcgtgccgaatccgagcggctggtcgtcgaatgattgtccgtgatgtacaagatcagaagccatgcgcccagcatgccagcatgcgccgtgccgcgcaaacaggcgacatcgctcgaaaaccgcgccattgcaaggttctagagcaccatataagaaaaaatgattgggtgaagtgcggggtgcagccttggtcggggctgtttgcagggccgaagcgggccctgaaaacacgctgtgagacacgccgataaaaccgcataattccgcagtaaaacaaggttcgcgtaggggctgatttgcatacctggaaaatctgtggttatatagccaagttgcctgttgaggtcaaacaccgcggcgggaaacagactggcggatttcccaagcggtcaaagggagctgactgtaaatcagccgcttcgtgcttcagtggttcgaatccactatccgccacgccccgatagctcagtggtagagcacttccttggtaaggaagaggtcgtgagtccggcggacggcacgtagcagtgcacgacgtgcacatcgcgtatgatgccgggggttgtcagcgcggctgactggggtggccgcggaccggtacctggacttgcagctgccctccggcgatgcgtgtcacctgcagcggggaacgtccgctgcagttacggctattaccggccagccgacagcaatcgctggtttagttgttggtcttttccggctggtcacccgttcccatgagctggcatgcacctttcagcgagtatctctcctaccgcatgccagtctacccatgcccgcgggataacccaaaaagccttgcaagaataccgaatttctttacctttggccctgatcgttcgacggctctcaagacggcgtaacctcatccaaccggccgatccccggaggcggaaccagcggaatcctcgtgaccgggaatgcgatcgttcccgcttgcgcgatggcggatgcgcgcaacgccaacgacgcatcgacaagccactgtatggcactctcaaaatccttgccacgtccaccagctcacaccacgccgtatacgaacttcttgttctctttcgccaactgggaaggaattgaatcccatacctgattgagacgaagcgtggtgacggcgggactatcacgcatatcaacatgtttggagaaatcgtcacgataatcggagaccagactattctgcaatttacgaaccgccgtgaagtcaggattcggcagagtactggcgaacgcttcaacgatctccggcatgcctcctgtatacatgaaataccgcagccaagtcatgaccctgtcatgcattacgttaattagcggagaatccttggactcaagcatttcggccaaggcatactgtttgcacgcatacaggaattcaacaaaagacataggatacagcttgagtctactgaccttgccaaccgggaatgaaaacccaggatgcatggcgatgccaagcgccgatccagtggccaagacgtcatactccggggcagcttcattgaacatcttcagcgaagtcatcgccctcggcacctcctgtacctcatcgaaaatgacgagcgtatcctcgggagtgatcctagttccggactcgatcgacagtgcgggaatcagccgttccacactcagatccgcatcaaacaacatacgcatgttggcattgtcgaaaaatgcgacacaacagcaatacgtaaggtacttgacaatctttgatggagtcgtatactcatatctgtcaggtacttgacataattactgaagaggatgaaaaagacacacgaccagcgacgcttcgctcgcttccttattaaaggagaccggcatgaacatcacacatgacatgagcaacgacctcaccgaatacgacccggaatcccgtcaagtagacggaccgaaccccatcgaaaaccgcatcagctcctccgcggcccgtgttcccgacatcatcagctgcacttccggcatcaccgtccagggccgccaactccactcgttcgcgttcaccacggacgcggccatcatccgcaacaccaatgccgacgccattctcgccgtatatccgttcaccggcgaaccagtcatcacccaggccctactcaccgcggcccaggccccgctgttcgtcggcgtgggcggtggcaccaccaccggcccgcgcgtcatccaactcgccatgatggccgagatgcagggtgcggcgggcgtggtgctcaacgcgccggcgccgccctccacggtgtacgacgtggcgcgcatcacgaacaccccggtcatcgccacggtcctgacctgcgatgacgaattggacgagaaaatcgaggccggtgcctccatcatcaacgtggcggccggccgcaggacgcctgacgtggtccagcagatcaggcagcgtcacccctccatcccgctgctcgccagcggcggttcgaccgacgagtccatggccgaaaccatcgtggccggcgcgaacgcgctgacctggaccccgccgaacgcgcaggagatgcagcgctcgatgatgatgcgctatcgcggcgaatccaccggcgacaacatgcagcactgacgtaaggattccgaacatgagcagcaccagcaacaacgccgccgtaaccggaaacgacgcggtcgacgacgtaatggccacgagtcaatcggcggagaacggcacaagccacgacaccgccgacggcgatatcaagaacgatgttctcagcagtttcatcagcattggccgtatcatggcgtatcgcgcgatacacagacggctcgtctcccccggcgccaaatcgccgcgcggcgaacatgctttcgacccacgccgtggccaaggccgcgtcttggccacgctcagggaatccgaccagaccagccagaaggacttggccgcgatgttcggcatgagccgccaggccatggccgaactgttgaagaaactggaggccagcggtcacatcagccgccgtccatccaggcgggacagccgcgtcatgatggtcagcctcaccaaccagggccgcaaggccgccgatctgctgggcaaagcgcccgaccagacctcctccatgctggactgtctcaatgaaaccgagctacaaaccctacacggctacctgcagcgcatcatcgacacctcctccgacgacctaccggcctcgaccgccgaggatgtcaaaaagtgtgagctgcttatcgaacacctcaagcgcaggcgaatgccgaccgaccgcgcatagtttgcgaacagcccgcacgacttgtggccgcataagcatgcggccacacaacagtccagccgcacagtcatccagccgcccctacaaacacacccgattcaccatttgcacgacatcttgcaccaaaccctactttgaaatgcggtattttgcaccaaaaccccattttgaaatgcggcattctgcacatacaaggcagaaaatgctactcccataagggatattgattttcatcgacgaggtgcaagaggcaccggatgtaatgaccacgtcaagtttgatgtaccggcgtcgcaattcggcgatttgacgtttcaccacatctcgctgattgcgaaaaacagcaagtcgtgattcgagcgtggcatcaccttgcttagtcatatcaacaaaatccttgatctctgcgagactcatgcccgtggatttcagacattcaatgagatcaagcaattcaagatcgccgtcatcgaagcatctccgtccgaaaccagttcaagcgataccgggcaaaagaccttggccgtcatagtagcgcaacgtatgttcggacagcccagtctttcgcgacacctgaccgatggaatatcccatgccaactcctttccctgcagtcgagccagtgtgagtccagccatattcacggatgtcctatgcggaacggacactcttcgactgcctgaaccttgcagcccaaacatgcatcaatcagcacaaatcacagacagtgggccatatacaacggcagcttgatgcgttctccatccacttcgagttggcggggatgcagaacgtattccttgcccaatcgttgggcataccttttgcggaatttgtcgagcgaagacacaccgtatcgtttcgtggatttcacttcgatcgggctgatgcgaggcttcatcgcggcattatcgtattcccgaacgatgaggaagtctatttccatggttttcgaggcatccgccctatccaagcgcgagaagaaatacagtttgcgcccattcgcccggaattgctgagccaccgcattctccaccagcatcccttcgttgagcgagagtttatcgaacagaatatcccggtacacatcatccggcgttgtctctcgatcggcaaacgcctgcgacaccagcaaaccggtatccgccatatagcatttgaatgaatcgttatcttcgtacaatcccagccccaccaaagggtcagtcgaattacggcacaggttcaccaagcgggcgtcttccaaccagaagaacgccgaatcgtattcacgagatcgagcccccttatcgaccgatgccagagtgaatcgtttctcatgcttggacagctgccctggaatctgagcgaaaatgccccgcacgcggccggcatcgccattggcgaacttgccgatatcatcactgtacagctgcaggatgccacgcttgatcaaatccacctcgccaaaatcgcgctgctcgacataatcggcaaccgcctgcggcataccgcccaccagcagatattcgcgccacagcctcatcgctcgtttgtgcagcgcatcgggcaacgggaccagacgctcgaacgatttgcgaatcgtttcagcaagcagctcctcccccatggcccagcagaactcctcaaaatcgagcggccccatgtccattttccgttcctcggaggggatgacgatattcgccacattcctcttgatggagatcagcgaaccagtttccacatagtcataccggccatccgcaaccagatatttgatgagctccctcgccgccggataccgctgcacctcgtcgaaaataatcaacgattcacgctcgtacagtcgcttgcggtaatacgcagacaacagcatgaaaaatgtgtcaaagtcatcacgctggttttcgaagatgtcgcgaacgtcgcgcggcaaacgtgtgaaatcgatgagaatatatgacttgtactgagtgcggccgaattcctcgacaatggtgcttttgcccacacggcgagcgccttcgatgagaagagcctcacgcccacccgctttttgtttccatgcgatcagcttatccagcatcttgcgcttcaacatgagcaatcacctcattacacgaaaacaacagtataggcatatgctattctacacgaaaacagaagtatagaaatggccgattctacacgaaaacaacggtatggaaacatgcaccgaaccggctcacccccaatctctcccccatcacaccggcggcctgttcgattgtgcggttttgtgcgaatggctcacacggttcttagtgagaaccgttctctgcgcacctgaccctagaaccggatcagcgccttgatgaccttgcgctggtccatcgcctcgtaggcgtcctggatatggtcgaggtcgtactcggcggtgaacacgcggccggggttgatctcgcccttgagcaccgcgtccagcagaccctcatcaaggtcatagtggcgcacgggagccgggccgcctttgatgccgatgttgccgtagaacgtgccttcggcgctgatctccacgtcgtgcggcagacccacacgaccaatcacgccaccgcggcgaatcaggccaatcgccgtgtcgaaggactgcttggagcccacgcattcgagaactgcgtccgcaccatagccgccggtcatctccagcaccttgtcaatagcctcttggccacgctcgggcacgatatcagtcgcaccgaattcgcgggcgagcgccgcgcgatcctcgtgacggctcatggcaataacgcgcgtggcaccgcgcatcttggcggcaatcacaccgcacaggccaactgcgccatcgcccatgaccacggcggtgtcaccgggcttgacctcggcagaaaccgccgcgtgataaccggtggacatcacatcggaaatggtcagcagcgatgcgagctgttcatcggaataatcttccggtgaaccgggcaccttgaccacggtgccgtccgcctcgggcacacgcaggtattcggcctgacaagcggagaagtagcccccgtgcgggcacacggattcgaagccggccttgcataccgggcacttgccgcagctgtacgggaatggcacgaccacgaaatcacctggcttaacggattcgaccgccgcgccagtctcctcgaccacgccaatggcttcgtggcccacctgactgtgtgcggcctgtccgctcagcccacggaagaaccacaaatcagagccgcatacacaggtgcgcaccatgcgaatcacgatgtcatcatcctgctgaagtgccgcctttggcacttcttccacggtcatcttgccaggctcaacgaaaatcgcggctttcatggtttcagacatattcacaactccttgtttccggcaccgagcgattagggcccgttatcctcatgttccattaaacgacaatcgatctgtattagccaatagccataaaccatgttgagccatacccacgaggtatggaagcaaccaagcaattcatctacgtgctttatcgcctcacggcaaccaagttcatcggcgttgcagaagtctcttgccgaaatccaccgcgataggccaatatccgagatactgctgccgtttgttgtcgccgccacgagtaggctaaggaaccggcgatggaacccgcctgaactcgtttcgaaccgcacactgctgatagttcctacacacgatttgatattgcatggaatcgttgtgtcttcagcaggattcagcggtttcaggaaaggctattatggattcgcaatccccatccgcaggtgcccggccgattacgcacacgaccactcccccggcgcgcaagctccccgatattcatcttgatattgtgttggtcgtcttctgcggcggtgcgatcggcaccgctatccgctatgcgttcgcacagattcccgcggctggcagcttccataccggcacgtttgtggccaacatgctggcttgcttctgctatgcagggttgaccgcttacttggccggcgcttcccggttcggcgcacgttccaaagaacttgccagtcgcggactcggcatgggcgtatgcggtggtttgtctacgatgtcgacactcgcgctggaaggttttaccgcaatccgcgacggtcaggtggcggccggcattgcctatctactggtgacgttcgcgctgggtctggtttgtgcgtctgccggcgtgtgggcaggaacgcatctggccggctcctcgaacgtatccgccgaagcgtccgctgatacgaatgccgctacgaccagcaagggaggtaaggcgtgatgaccgtattcctaccaatcttggtctgcctgtgcggcggcgtaggcgcctcctgccgctatctgcttgacgtgaccatcaaaacgtactggcagcgcgcattcccactttccacgttcaccatcaatctcatcgccggattcctagccggtttggtcgcggcgctggcactcggcgggacacttgatgaaccatggcggctagtgctggccaccggtttcctcggcggcttctccacgttctcgaccgcaatcaacgaaatggtgacgctcttccgcaaacaccgctaccccaccgcagcggcctatctggtgctgtcgctgggtgtgccggtcgttgctgcggcctgcggttttctcgtctgaccgccacgccgattcccgacgcggtcagcggtatcattgcgaggtcgaacgtcacaggtacatccgggaggtatatgggcatggcgaacaatggagcggatgtgaagccgaatcaaggtgtgggcgccacaaatacctcgaccacaacgaatactgcggaaaataccgtgggcacggcaaccccgaagcaaaatggactcgccgtgctgggcaagtatgtgggtgtttccgccacgcagaccattgtggagtatgcgacgttcgccattctgcacttgatcggcgtaccctcacagatcgccaacggcatcgccgtggtgtgttcggcgacctacaacttcgtgatgaaccgcaacgtgacattcaaatcgtccagcaacttcacccgttccgtggcgctgttcgtgctgctgtggatctggaacttcacgttcagcacgctgctgatcggctggatgccgggtgcgaccgggctgagtccatatgtggtgaagttcattgcgatggcctgccagttcggctggggttatccgttgtgcaagtacgtgatttttaggtgacacattccaattgctcactgtcgttcgccttcgcctatttgtatttggagcgcttatcagaagaacagcatcgcaacacctgcagcgaagcacatgagcagaatcgatgtcaggaagctggcgagcatcggcttcttgcccttggaagcgatggccttgaagttcacgttgatgccgagcgcggccatggccatgccgagcacgatgtacgcaaagtccacgagctgcggggtgatggaggtgacgaacggtacgaaggtgccgataatcgaagcgccgatgaagccgagcatgaaccacgggaaggccacggtcttcttgccggtgctctgaacctcggaatgcttcttctcccaccagatggcgatgatgatggccgcgaacacaagcatgagcacgcgggaaagcttcatgatggtggcgatgtccaccgcgccgaacgcgtcgccgcccgcgaccgcgtgggcgatttcgtgcagggaagcaccggcggtgatgcccagctggtccttggtcatgccggtcagcgggccgagcgcgatctccagcaacgcgaacacagtacccataatggctacgatggccacggccatggtcacgtcgttgtccttctcgtcctgcttgtcctcaggcaccttgatggaaccggccaggcccatgacggcggccgcaccgcagatgccggtgccaccggcggtcaggatggcgagcatcgggtcgacaccgagtttgcgggcgatggcatagcacacgatgatggtcagcgtaacgaccacagcggcgatcggcagacacttgatgccctgcgtgaacagcacggcgaggttgagcttgaaaccgagcaggatgatgccgaggcgcagcagcttgttggaaatcaggccagcggcgtccttgacgcctgccttgcggccatcattggaaccgacgtaggcactgcggatcgggaactggatgatcataccgatgagcagcgcgatgatgagcgcgccgaacaggctgaatccggggaactgcttgagccaagaggcgaacagcgaggccagcagagtcagaacaccaatgaacagcatgtcaacggtggcaatgcgcttccaccattttgtacagaactctctcatgatgtctattgaagctcaagcgtttacatcggtcaaatcattgcaaccaatacatatcatcgattttgtcgatacctaattgatctccctctgatgagagaggtggccgccgcaggcggacggagggagagaaacaacgttcgcaacctcccctcagtcgactatctgactacccgcgcagcgcagcaataatcgtctccgccaactcccgctgatcgtgcgtcagaccggatctcggcaccagcgcatagaaccgccgcacaaactcatcgccaagctcccgctgcaccggcacgcccgccggcacggcggcttccgaaatcaacgactgcccgaacccggcggacagcgccgccacaatcgccgcattactggacacttccatcgtgcgtgcaggcacaacctgagcggtcttgaaatacagatccgtgtaataccgcacgccggaaccgtgttcgcgcaccatccacacgccgtcaggctcccccgccaacaccagccggtcctcgcacagggtgacgcggtccaccgaatcgttcacgatcggcttttccaccacgccgagctgcacggccttcatgctggcctgttcgagaatcgcatccgagttcatcacgtgtacagcgaagtcgaaaccgtccatgtcccgagccatcaccggcaacgccttcggcagcagaatcgccgcggtcgtgtgcgagaacgacacggccagcggctcacgcgcctcctgcacgcgggcgatctgctcacgcgtatcccgccataatccgtcgatgccgatggcagtctggtacagcatccgcccggcctgtgtgggcgtcacgtcacttttcgcattgcgcacgaacagcggcgcgccgaccatctgctccaattgggcgatacgcgacgacaccgtcgactgcgataccttcagctcatcggcggccagcgtgaactgacccacctcgtatacggcgaccagggtttcgagcagagggaacatggtttaactgtacgctgtatgatgcacgaatatttcaattagcttgggcgtagccctaggccacggacctggaccaccctcagtctcgcttcgcgagccagctcccgccagcggaagcccaatggctttcacatcactatgcctcgcgcagttttgcgagctgcgccttggccttgtggagtttggcatagatctcgttgcgctgggccgggttcttgacgcgctgatggtcacgagtgagcttgtccacttcggattcgagccgagcaatttcagtatggcgaatgatgcgcgcatccagattctcgacctccggcgtacccaaaatggtctgtgagcacagcgatgcccacagctcatcaatagtagagccggccagctccagctgggcctcccccgccggctgccagtcgccggcatatacctgatagatcggcgtgtgcccggcacgccccggtatggcgcggcgcacggcgaacgcgcattcctcacgcgtgctgccctcgaacggcacgtcgcgtacgcacacgaacacgatgcccgatttgcgctgtccggcgatcaggtcgatgacttcgttcggtatgccggtggctttggccgtaagcttcagtccgatgaccagcacttccgggatcagtttgccgtccgcaagccccgtgttggccgaccgggccaacgccagcatggtgatggattcgatctcgttcaccaatcgctgcttgagtttgccggaaatcggcgctttgcctacgaacaaggctttcggcagtgtgcctttggcttcgggaatcgccgtggaaacgggcagtcccagcgaaattgcggatacagaaccacagtgagcggcctgtgcaccagtcatcatcgaccttctttcccggcctgccatcagtgtcatatcctcgcagtgcagcagtccgtttatctattgaaaagcaacactagcgcatccaggccggaagtcgtggtacatatccatatcctgctgcggttataggaaatcccctccgagtttcctcgaaggggatttcctataacgctagttcaagcgaagattcttgtctgatgaaaatcaggcgaggatcttggtcacacgaccggagccgacggtgtggccaccttcacgcacagcgaaggtcaggccttcctccatagcgatgggctgaatcagctcaacggtgaaggtagcgtggtcgcccggctgaaccatctcgacgccttccggcagctcgatgacgccggtgacgtcggtggtgcggaagtagaactgcggacggtagttggagaagaacggcgagtgacggccgccttcgtccttggtcagcacgtagacttcgccctcgaacttggtgtgcggggtgacggagcccggcttggccacaacctggccacgctcgacatcgtcacggccgagaccacgcagaagcagaccggtgttgtcgccagcctcgcaggcgtccatggtcttgtggaaggtctcgatggaggtgacggtggtctgctgggtcggacggataccaacgatctcgaccggggtgttgacggccagctggccacgctcgacacgaccggtgacaacggtaccacggccggagatggtgaagacgtcctcgatcggcatcaggaacggcttgtccaggtcgtgaaccggggtcgggatgtagtcgtcgacagcgtccatgaggtccttaacggactggacccacttctcgtggtccggagcgtcgtcgtgcagagcaccgtaagcggaggtgtggatgaccgggcagtcacggtcgaagccgttctcgtcgaggaggtcgcggacctcttcttcgacgagctcgatgagctcttcatcgtcgaccatgtcgcacttgttcagggcgacgaggatcttcggaacgccaacctgacgggcgagcagcacgtgctcgcgagtctgggccatcgggccgtcggtggcggccacaacgaggatagcgccatccatctgggcagcaccggtaatcatgttcttcacgaagtcggcgtggcccgggcagtcgacgtgagcgtagtgacgcttctcggtctggtactcgatgtgggcgatgttgatggtgataccgcgggcggcctcttccggagcggaatcgatctggttgaagtcgtactccgggttgacatccgggaactcctcgtgcagcaccttggagatggcggcagtcagggtagtcttaccgtggtcgacgtggccgatggtaccgatgttaacgtgcggcttagtacgctcgtacttttcctttgccattacttttgtcctcctggacgtctcgtgagtttcctgcaccctttcgcacaggaactcgcttattctactgggtttctgggttatgtgccactttgaagagccagaacccagtcagcggtatacgatattaccgctgactgaagacactggctacttcatgcagtggcgcgtgtcactcgccgcgctgggccttgatgatctcctcggagacgctcttcggcacctcgtcgtaggagtccatctccatggtgaacatggcacgaccctgggtcttggaacgcaggtcgccgatgtagccgaacatctcggacagcgggaccttggcgtcgatgaccttgacgccgacaccgtcggtcatggactggatgttgccacggcgctggttcagatcgccgatgacttcgcccatgtactcttccggcgtacggacttcgaccttcatgatcggttcgagaatgaccggcttggccttcggggcagcttccttgaagcacatggaacctgcgagcttgaaggccatttcggaggaatcgaccgggtgcatctggccgtcagtgacggtggccttgacgcccacgaccgggaagccggcgagaacaccggactccatggcctccttgacaccggcctcgatggggccgatgaattcggcggagatgtggccgccggtgaccttattctcgaactcgaaggtcttgccctcggtggtgtcgagcggctcgaagttcatcaggacctttgcgaactggccggaaccaccggtctgcttcttgtgggtgtagccctggtccatgacggccttgcggatggtctcgcggtaggcgacctgcggcttgccctggttgcactcaaccttgaactcgcggcgcatacggtcgacgatgatgtcgagctggagctcgcccatgccggcgatcagggtctggccggactcttcgtcggtcgtgacctggaaggtcggatcctcttcggccagcttggacagggcgatgcccatcttctcctggtcggccttggtcttcggttcgacggccacctggatcacaggatccgggaaggtcatggagtcgagggtgatcggatcgtcgatggcgcacagggtgtcaccggtggtcacgttcttcaggcccacgaaggtgtagatgttaccggcgtcagcgcggtccatcgggttttccttatcggcgtgcatctggaagatcttgccgatacgttccttcttctcgcgggtggagtcgagcacggagtcgcccggcacaacggagccggagtagacgcgcacgaacacgagcttgccgtagaacgggtgggtggagatcttgaagaccagagccgcgaacggatcggacttgaccgggtgacggtcgatctcgacggactcatcgccaggcttgtagcccttgatggccggcacgtcttcaggagacggcaggtaatcgacaacgccgtccagcatcggctgaacgcccttgtccttgaaggcggaaccgcagaagatcgggaaggcttccttggcgatggtgagcttacgcacgccagcgcggatgtcttccttggacaggtcgccgtcctcgaagaacttgttcatgaggtcgtcgtcggcttcggcagcggcttccacgagcttctcgtggtactcctgagccttgtccttgaggtcgtccgggatttcagtggtgtcgtacttggcgccgagctcctcggtgccgttccacacgtaagcctgcatctcaaccaggtcgacaacgccagtgaagtcgttctcggaaccaatcggcagctgcatcacgatcggagtagcacccagcttctccttgatggtgtcgacggagtagtagaagttcgcgcccagcttgtccatcttgttgatgaagcagatacgcggaacgccgtacttgtcagcctgacgccacacggtttcggactgcggctccacgccttccttgccgtcgaacacggcaacggcaccatcgagcacacgcagggagcgctccacctcggccgtgaagtccacgtggccaggggtatcgatgatgttgatctggaacttgtccttggtgtcgtgggactgacggctccagaagcaggtggtagcagcggactggatggtgataccacgttcctgctcctgcgccatgaagtccatggtggaggcgccgtcgtgggtctcgccgatcttgtagttcttaccggtgtagaacagaatacgctcggtagtggtggtcttgccggcatcaatgtgggccatgatgccgatattgcggacgtcgtggaggtccgaaatctcttcagccatctttttccttagttttactcagggcgagtgattaccagcggtaatgagcgaaggccttgttagcctctgccatcttatgagtatcctcgcggcgcttgacagaagcaccgaggccgttggaggcatccaggatctcattggcgagacgctcagccatggtcttctcacgacgggcgcgggagaagtcggtcagccagcgcagcgacagggtgttggcgcggttcggcttgacctcgaccggcacctggtaggtggcgccaccgacacggcgggagcgaacctcgagggacggacggatgttgtccagggcgcgcttgagcacagccaccggctcctggtcggacttctccttgaccatatcgagcgcggagtagacgatgtcttcggcgatcgacttcttgccgtcaagcagaatcttgttgatgagctgcgccaccacggtggaaccgtagatcggatcgggcagcacgacgtgcttcttggaaggtcccttacgtgacatatctcttacttcgccttctttgctccatacagggaacgaccctgcttacggtccttgacaccctgggtatcgagcgcgccacgcacgatgtggtaacgcacacccgggagatccttcacacggccgccgcgcacgagcacgatggagtgctcctgcagattgtggccttcgcccggaatgtaggcggtgacttcgatgcccgaggacaggcgcacacgagcgaccttacgcagagccgagttcggcttcttcggggtggtggtgtagacacgggtgcacacgccgcgacgcagcgggctgcccttcagggccaaagtcttggacttcttcggctttgcctgacgtcccttacggacgagctgttcaatagtaggcaacttgaattctccgattcagtggtttctcttgcttttgtgtgaccgccgcactgcacccacacttttcagcacactcgcttggtatccacctgttgacggcacccgacgaatcggaaaagatagcccagtccaccggcccgatggccttcgcccctcccgtcggcgcattactgcgtgcgatcagcggtttgaaggatatcccagcatgctcgcctgttacataaggcgtgctgctggcacacacgaatatctatactacgattcctccggacaacgacgcgccgagccacaactcactggtttggggacctcctgcgcccccgtacttttcctctcctcccaacgcaatattccaatgcgtcgcaaaacacacacccaactattctcccaacgcaatattcccgggaatgcgtcgcaaaaaggggttataggccaaaatgtgtgtccgttttggcttgtgttcctttgtggcagtggatatatcatagcttgacggtgctgaaaggggagcagtaacccatgaatgagcctgttcgcattctgcagtggggcatggggccgaatcttggcggtgtcgattgcctgatgatggatatctaccggcatatcgaccgatccaaggtgcagttcgatttcctatgcgatcatgatgcggacaagctggccttcgaggatgagatccttgccttgggcggtcgtgtgttccgtgtcatggtatcgcagcacgaatccatgatgaagtcccgtactgcattgatgtcgtttttccgagaccatcctgaaatacaaggcattcacgtaaacgcgaatttcccatacgcgcttcctcttaaatatgcggcggagaacggagtgcagcttcgtattctgcactctcataacgcgggtaccgctgcgagccatgaccatgatgatttggctcatacattgatatggtgtcttcgggaatggcagactagacaccaaattagccggtatccgaatttgtattgtgcttgttcaaaggccgccgcagaatatatgttcccgggcaagccattcacgtgggttcgtaacggtattaacaccgtgcatttcgcttatgatgaagtggtgcgtagtgccacgcgcgctgagctacacattgcaccaagcacctctgtgattggattttgcgggcgattccgtacacagaagaatccgttattcctgctggacgtattcgccgaatatcaccgcatggtgcctgattctttgctgatgttggttggcattggtgagttgcgttcactcatggatgagcgtatcgagcagctaggtatcaaagattctgtgttatacatggggtcgcagcgcgacgtgtcgccttactaccaggccatggatgcttttctactgccttcgctatatgaggggttaggcattgtgtatgtcgaggcgcaatgtgcggggctcccatgctttgcttctgccgatgctgtgcctccagaggccaaggtcaccgatttgttgcactatgtgtcgctgaaagaatcagctgagcagtgggcgcatgagatgcgcgatgcccttgaaaagacaggcgaacgtcggaatcatgccgatgatgtgcgtgcggcgggctacgatattcgcgatgtcgccgcacggttgcaagacctgtatctgaacagagcggggagagcatgatgccagagaattccccgaatcagcctatggtaagtatcgtcgtcccggtctataaagcggaacgttttttagacgaatgcattcgcagtattgttggccagacctactctaacttggaaattattctggttgacgatgcttcacccgaccaatgcccacggatatgtgacgagtgggctgagcgtgatgagcgggtatccgtaattcatctggacaatggcaagggagcttccggtgcccgcaatgtgggcttggatcactgcaccggcgattatgtgatgtttgtggatagcgatgacctactgaagacagatgcagttcgttacagcgttaaacaagtgttagttggcgattatgatctggtgatattcggcaaacactatatcgatgagtatggaaatgtatcgcgcaccaatgtgattgaccacgatatggcagccattgccgatgaatcggattattacactacattgtcttatctattgcgcgctgactaccttaacccaccttggggcaaattattcgcgcacaggttggtggagcatgttcgttttgatgcggcgatgtgctatgaagaagatcttgtgttcgtgcttgctgctcttgaagccgagcctaatgtgtttacctcgagcaaagcgttatatgaataccggcatctggagagcggtatggcaagtgtgttcaagcgagagaagtcgctgaacgtggtccaagcgaatcataagaaaatacagttctttgcggattacatgaatgataagggggtatgcgagaatgtgtctttccatatagccaatgacatcggctgggtgattcccatgattaaaggcggcaaagaaattagcgcttcgcagaaagccgattacgttatggagatgaccggtgattcgcaattgcggccttgcatgatgaaagcattgaatcattcatggatgacacgtttgcagaaaatacttatcaccttgaattggaaatggctatgggaaatttatctacgatagcaagggagatgcgttgatgcgtgatcgccctcttgtgagcataatagtgccagtatataacgttgagaggtacctgaatcgatgtatcaaaagtatcatcacgcaagaatataaagagctggaaattattctggttgatgatggttctctcgatggctgcccactgctgtgcgataaatgggcggaacaagataaacggatcagagtagtacatcaagctaatagtggattatccgctgcacgcaatactggtctagagatgatgtctggcgaatatatcgcattcgtggatagcgatgattaccttgattctaggtatgttgattcaatgctgtcggccattatttccgggaaagcaaatatggccatttgttccatctgtatagaggataataaatcaagaatatcggttgataatcatcgtattgctgatgaagtggcattcgttaatagtaagtattgtctaaagcgaatgcatggtaactctagtactgattatgtagcggcttggaacaaactgtattctggtaagttgtgggatacgattcgattccctataggtcggttgcatgaagatgagagcaccatatataaagttatcgataattgcgataaagtagctttagttccacagcagctataccattacgtgcagaatcttggtagtatcatgcacacggattattccgtccgcaatcttgatcgtattgaagcttggattcaaaagttacagtattatcagaatgctcgatatcgagatttatatgcaatgacattcaatcagattacatgggatcttgcacgtgcacgtcagtatcttgattggaatgatgaaattgtccatacacgtctgcgagaaatattcagacaattacatccattttcctttgatgtgatgattcatgttgatgggtggagaaattcgattaggtatattgctctatgtttctgtccttttcgattctcttcattcaaagctgttctttctggtttgaagaaataagattatgatctgctagacacacctaagtgtacttttccagcctattgtaactaatatgcaattaccatagcgttatgggaaagctgagtagagccgcaaggctggtcagcggagttcgggatgggctagctaggaatcagtaaatacgaatagaaggatacatgaatcgcgtgtaaaaaacatcctcgataacatccagtcgttgagcgtcatttgctgattattccgatgccttagttatgttatcaataggtcattgataacataaggtgtccgcaaacgctcatccagggtcggtcgttctcgatgctgagtaaaaaacgtactttggtctgacggacccgggggcttcacgattgagatgaaattacttttttatcttcgtaattagcttacgggtgataagagagcgctctctagagctaagaagaaatatgatgtttataaatatagtggttaatgtataaatagtgcatgcaatgaataatgatatccatgatgttatttttggcattagcatagaatgaagaataaaacaaattactatactaacgattgtagaagtaatgtattgcagatagatggggtaaaaagaccaaagtgggagattcagacaccgggaggcatagagcggaacaaatgtgaggttggcaacgaatcccactatctgtggtacggcggccaccatgtatattccggatgaggggaatagatgaactcctaagattataagggcgaaagaaaccgcgccacatgctaaccatcctaaagaataaggccttagtttattcacaagaagtggaacattttgtaacgtggtggcgactccagagagaaagaatcccaacatcgttaattgcataagaatattaatcatttttgtgtcttgtcccggttgccaaatgcggataaaatcttcgccaataatgagaaggacaacaaaaataatattcacgaaaaaaccgcagattcgcatacctgatttgagttcttgtagcagtagttctttttggccgcgagcgaaaaatttggtttgttcgggagaaaatagtccagatatagttcccataagtcctgacattgtagtggggactaattgtgcaatggaaagaagccccatgaaatgcggactaatgagaagatttgtaacaagaaggcttaatccgtcttgaagaatctgttgtagtttgattacgcagttccatatgccagccgcgagcatttcacgaatggcgctcacagaaaagccgtggcggatgaaacgaagttcaggcaccagcttttttgtatatatccaattggcaatgaatgtgatcgccgtcattgcacaggttccaagaccgacataccataccattggaggtaatgttccaaacattgcgataagtataagaaccttcgctagtattgcaacaatattcgctatgctacttagatatagcttgttttttatgaatgttgccacagtaaacactgtggaaagagtggatagtaaaaaattaatgaagataaaagaaaataggattttcacatcattaattaaatgcggggagatgttaacaacatgctccaaattccagattaaaggaaccgctatcatggtcagtattgcaacaatgacaagattcgatgataatgtcgatgtgaaatatttgtcagcagtcgacttgtctcctttgtggtacgcgactgtgataaagcgcccggatacggagttaagagctaaagtgaacaatgttgcgtagttaatcattgtattagctaggccaacgaagccgtaggcttcagctccaatttgttgaacgataaatggcgtcattaaaaatccgatgcctagattcgcagcgaaagaaatcaagctggcaaaaagatttaaaatgaattgacgtttattgtccaaagttggtttcctgtctatgattatagagggtaacgacgaaccagatgattgaattcttgtttaagaaattttaaacaatgttttgtccaataccatctacgacggcgactaataatgaagaattctgggagtaagtccgagtgcatccccgtttttttatcatcacgatattcgtccaacattgagaaccagcggcttggtaagcaacaataaatgtcaggcttttcataatgacacatgagaagtataatttgatcgtcatcaagtaatccgcaacgtaaaagatgctcatattggtttcgtacatcaacatagaattgttgtgcataatcagtatccaattcgatgcagtttccttgaatatatgtttcagtgcgtcgtatgcaatcaaaaattggatcggatggcaattcgcgaatttggaaaagcgcaactttgccatttgggcgagtatagttccaagtgcggtcgaaccactgattgtccttatagtattcgccaccatggtcaaagccaaaatcaatccaagcaattttattggttgcagcgacagttgaggcttgtgctaggcaccagaatttcgtatacatgacaaaatcgtaaattggattacttacttctggcttatctgggaataagctatatttgggatagtgttttccgacgtcatgcatcaacgtatacattgatttgtcgatatcttctaaatcgttaacgatatagacttgtgtatttgttcttccgaaggagagacgtatttgtctaatgcgttccgcgttttcgggggtcgtgtatacgactaaatcattgtgtatcctcgcccaatgctgaaagtatttgaagtatttgtcatctgaccgttgggctttccctgtccattcccccctaccgattgggaagaatgctgtgactaaagttattccatcatgcataatatggtacattctatccggtgcacccgattgaataatggttttgccgagcatattgatcattccgtttcagcacttctgcctgttggacatgtccgggcggatcgccctctccttccacgcgcgggagaagcgcggcgagcatgagcgttcccatcgaagggtcttatggcgtgcgaggcatcgtcgtaacatctcgggtattcggcaaggatatcgctgccatcgggattggtgagcgtgaatgtgttctagtgcaaggcggccagcacgtgccgacgaacccgcggtccgagggccattccgggcttagatcgcgcatatccgcgtacttcgtgaccgtccccgatcgacatgcgcaaccgtgctatctgcacgcgggacatcccctgccggtcgagtctcctgatatcttgctgaatgggcatcggtatcgccatgatcctttccttcccgagcgccggttgtctgcaaccggcagaatccgattcgaattgcaactcgggaatatacaagcggcggcatcgaggcctctcacatcaccgggaaacgatgacgttacccgggaaaaccatcagcccacactgcggaaaaacactgcctgtcaacaaacatcgaagcaaaacactggaaccgggtttgcgccggcgttccaggcggcccttgccggccggccgcgccgattcccctgacagccttctggcggtggacctgcccatgccgacctcgaccagacggtcgaggatgagcttcttctccttcttcgaggccttcgcgtattcgtccttgaaacggttgtttgtgttcaattagttgttgcgggtttagtcacgatgatttttcgggtttcaccacggccgcgtggcggatgtcgtcgaccagcaggccgcgttcgcgcggctccatccggtcgagcagcacgcgcgtctcctccgggaagtcggagcgtatgggactctcgccccacgaacgcggcttgcgtgcgatgatggcgagcagcgacagcgggtccatcgcggtgtcggggctgcgcccccacctgcgctccaacgtgacgatcggctcgccgtccatggaacgcagctcgacccgcagggcccgcacgccggccatgagacgcatggaatgccatttcgggcccgcgaggtagcggttcgagtcgatcgtgaccgttccggtcctgtcggccttcaccccgcgccagtcgcacgcgtcgaacatggacggcggcagcgggagcatgtggtcgaggtccgtctcgaacaggtcccggatcggcacgtcctcgcggtagtggacgccgcgcgcgatctcgtcgcagcgttccaaccacgcgtccgtgagccggtcccatccctccgcggacggcgtcggcaccatcaggttgcggcgcaggaaaccgaccgcgttctccgtgcttcccttctcccagccggaataggggttgcagaacctcgtctcgaagccgtagtgcgcgcagaacagcgagaacagcctcgtctgggtgacggtcccgtcggccctgcggtggccgaccccggtggcgttgtcgaacactagcacgcgggggaccatgccggcatgggagaacaccttgttcagaccatggcacacgcattccgcggtctctcccggcagcgcggccacgtatctcatgttcgagtacgggaacgagaccaccaggaaatgcacggtccgttccacgccggcgaccacggccagggcctggccgaaatcgacctgcgcgctgcccggcgcccattccagctcactgaacccctcggcctcgccgcggtggcgttggcgccagcgcttgacccatcgctgcaccgacgaataactgccctcgaagccgcattcctccacgagccgctcgtgtacgcgccgggcggtgtgccgctgtttgcgtggcatgcgccggtcggcctcgagccattcgtcggccttgcgcgcgtactcgcccgcgaccagggaacggctcgcagttcccccggtcggcggaacgggcgaataatcgcgggtcgcgtacttgaccacggtcgtccgcgaaacgcccagttccctagctatctgcgtatgcgtcaggcctttcgtctcgagctgcctgatactctgttgaatacgcaccggtgtcgtcattcctttcctcccgaggaccatgtgttggttgttagcactcgggaatctatcaggaaccgtacggcaccggcgcttttcttccgccgatgccatttccgtccgccgtccgtgtccaatatgaacgcttatgccgttcagatttggtggtgacgccgtacacgtttatttgaccataaacatgacgaaggtgaagctgaacgcgcggtatccggtcatgatgtcggtgacgtgcgcgcggaacaggtggttgatggagccgcgcacaagtcggttgccgaagttgtggaacgggcgcttgttctcttggaaataagtggatgagaggcggtcgccgatcaccatgtcatagccttcgagcaccttggtgactatgtcgggcgcggcggcgatttcggccgtgcggtcggtggagttgttgtcgtacacgtagatggccgcgtcgggcagcgccgcacggaagtcgcgcaccaccttgccgatggtcacctcttcgttataacaaggcaggagaacggcgacggtctcattttcgcctcaagcagggggcattgctatacgcgttgactcgtatgatgaggacaaaatagatacaatccaagcactgtaggaggggccgtcacgctggccgccggtccctcctacagcgtggtttcgatgcggtaacgggggcgatgtttggattccatataaatcttgccgacgtattcgccgacgatgccgagggagagcatgatgagtccgccgatgagccagatggagatcatcatggacccccagccggcgatggcgtggccgaacccgagcgagacgagcacgtacacgaacatgccaatcgctaccaggatagacagcagtccggcgccggtgacgaagctcagcggcttcgtggagaacgaggtgatgccctgaatcgcgaaggcgatcatcttcttcaacgggtatttggattcgcccgcttcgcgttcgccgcgctcgtagtagactttgctggtctggtagccgagtgtgggcacgatgccacgcaggaacaggttgacttcgtggtattcgctgagcgcgtcgagcgtctcgcggctcatgagacggtaatcggcgtgatcgggtaccgtctcggcacccatccactcgaacaccttgtagaaggcttcggcggtggtgcgcttgaaccatgtgtccttcttgcgtgcggaacgcactccgtagacaatctcgttgccgttgcagaatccgtcgatgaactcgtcgaccgcgttcacatcgtcctgcaggtcggcgtccatggagatggcggcgtcacagccgtaggcgcgcgcggtcatgagcccggcgaggagcgcgttctgatggccacggttgtgggagagctttacgccgccgaacaagtgtgcgtcgcgttcgtgcagattgcggatgatgctccaggtgtcgtctttggaaccgtcgtcgacgaacaggatgcggctttgtttgctgatccgtccggtttcggtaagatgtgcgactttggcggccagcacgtcggccgtgtgcacgagcccttccgcctcgttgtagcagggaagcacaaaatacacgaccggctggtcgcggcggtcggcgcgctcgccggaaccatcgccaccggcgctcgtgatgcccgctttctgcgtgtttgtctcgaagatcatcttcccatcctcatactcagttcgaagccgtctcatcccggttccggcccatgctcatgtgctatagatagtttagctgtttgcgtaatgtcgtgcgtgattttctcggttcggtcaatttcgatatttacatgttgatgcttgcgttcaggttcctgttgctgttcggcatgcgtattcgtgtcgcttgtcataaaccggttcttgatgtcatgagcttatcatgatgcaatcatgataagctcatgacagagtatttatcttcacgttatcatgagatttcagacgtgggtttggggtcgattggaggcgactgcttggatccatgtggtcgcaacaagtaagacaaataagctgatcaagggggatgatgatgtggacgaatgacgatatcgccgaggtgctggaacatctacgtgtccaaggcaacgatgacgcccgtttcgaggcgaaatcctgtgcgcggaccatcggcaccagcgtgtgggagagtgtgagcgcgttcgccaacaccaagggcggcgtgctgttgttgggaatcagcgaggacggggatttctcgcctgttccgggattcgacgccaaccatattgcatcgcagttcatggatggtatgggagatggcaatccgcaaggagcacggttgacgaatcctccggagtatgacgtttcccgatgcgagcagaacggcttgtcgttcctggtcatcgacatccatgaaaacggcattcagcacaaaccctgctatcttacggcgagagggccgcaaaccggtgggtaccgccgtatggacaacaaggatttgagattgtcgccaaccgaagtgttcgaaatgacccatgccctgacgcccagttccgcggatcgtatggttgtccctgaagccgacgtctccgatctgaatgccgaggcggtggacagggtgcttgccgagcatcgtaattccaaggcgttgcgcgggactgatactcgtcttgagcgcatgaccagattgaatatggtgaacaaggttggagaggtgcgtcttgcgggactgttggccgccggacagtacccgcagcagtactatcccaagctgatcattgacgtcgtcgcacatccgggtgtcgagaaatcggcggttgagggtccgcgtttcgtggatcgtgtgcaatgcgacggcaatatgccggaggcaatcgaacaggcggtggaggccatcgccaaaaacctgcgggctcccacgttcgtcgtgggggtcggagcccgtaccgatagcgagattccaaaggaggtgctgcgcgaggtcgtcgccaatgccgtggttcacagggaatatgatgcgcaattcctcggagaatccgtgaccgtggacatctaccccgatcgggtggaggtgtcgaatcctggcggattatggggtggggtcacgctggccacgatcggcagcggcgtgtcatgctgccgcaatgcgacgttgatgcagctgcttcatcagataccgtatgacgatgcgaatgatgtgaccgtggaaggcggtggctccggcatccctctggtgattcgcgagatgaaatcccgtgcactgggggaacctgtgttccgcgcaactcccgatcggttcacggtcgttcttggacgctacggcgtggagcagcaggagaaccgtgactggcttgatcatgtgggcgtccccttgactcgtcatgaacgtatggcgttgctcttgttgaagaggcatggcgatatgacggttccgcagttgcatgtcgcgctgtatctggattccgacgacatcagggtgattttgcatagattggtccaagcgaggctggccgatgaaatcggccctgatcggtacgcactagcggagaaggtcgatggtgaggagccgagtgggggccgtaagggtcttacggcatcggaatccgcgatactgtccgtattgtcggcggataagccacttgatgtccacgaaatcggccgtcgctcggggaagggccttcctacgacgcgcaaggcgttgagccggctcgttaaacgtggactcgttctcgccactgcgccgccgcgcagtagaaacaggaagtatcttctcaaaagataggatgatgccgtcgctggaatgtatggcggagctccgccgattttgcccgcttcgctccgtctgtcttatccgccttgctcattagactggagcacggttgaaaacgttgtgattacgcctgtttgcgcctgcctgttcccgcgtgtgagagtccggtcgaccatcggaacgcgtggcggtgtgcgggtgcgcgggatgggtgtgtcaaggagttacgcatggtggaaaagaagcggttcgacggctcggatgcgatggatacgacgggcatgctgcgtgcgttgcgtgcgcgtgcaacggcatccggcgcggtgcgcggtgtgactgcggcgatggcgtccgtcgcggcgatggcgatgttgggcgcggtgtgcgtcactccggccagcgcactcgcggatgtgaacgccgacgcggacgcgtccggcgtccggtccgcgacttccgcgacgcgtccggtcgcgaacggtgtgacggtcgccgatgagacggctgccgacgcgatgccggacaatccggatgccgagctgccggacaaggtgtccgccgagatttccgatgacgcgacggtggtgtccgagcaatatgcggctacgccggaaggcgagttgaaggacatcgagacgggcgagacggtcaccgatccgaagatcgtgggcacggagagcaagcagcccgatccgttggcgaagacggatggtgagtcgttcattccggtgagtgccgcggatgtgaaggagaaggtcgctgcgaacggcggtgacgtgaacgcggtctcctcgaagacgcgcgcggccaacgcgtcggtgaagctcgccgcgttgcagaacaacgagtacggtgcgcactggggcacatacaacggtacgcaggcgttcttcgacgcgcgcaacaacctgttcgcccagcaggcgaagggcgtgatcgacgtgtccgtgtggcagaacacgattgactggcaggcggtgaagaacgcgggcgtcgagggcgcgatcatccgtctgagctacggctggggcaatggtttcgacgcgcaggcgaagcgcaacatcagcgaatgcaagcgtctcggcatcccgtttggcgtgtacgtcttctcgtatgcggaaagtgcggccgacggtgcgtccgagggcgcagacgtggtgaacctgctgcgccaggcgggcgtgaacccgggcgacctgagctacccggtgttctacgatctggagaactggacgtacacggggcacaggagcccgacgagtccgagcgtgtacgacggcatcgtcaactcctggtacggcaaactgcaggcggccggttacaacaatctgagcgtctactcgtacacgagctacctgaacagcgcgctcaacagctccaacatccacggcaagacccgttggatcgcccagtatggctccaccatgcagtacaccgcgttccccaccaacgaccgcggctggcagtacacgagcggcggctccatcaacggcatttccggccgtgtggatatgaacgcgttcggtaactgggagtatcaggccggctatgacgtgcgtggactggaaaagctgtcgctgcccaagggcacgttctatgtcgatgcggtgaagcggctgaagtcgtcgttgctgatcgagaatggttcttcatccgcgggcgcggtggctcgtctgcagtcgggtacgcaggatgcgatgaagttccagttcattcctcaaagcgacggctcgtacgagatcgtgaacgtgacgtcggggcttgcgttggatgtgaagggcggcaacgccgtcgtgggtgccgcgattcagcagtggacgcgcaacaacacgtccgcgcagcgctggtggcttcgtgtggcgaacgagggcggcgtgtacatccagtccgtgctgggcaattgggtgttggatttgaccggcggcaatacggcggacggcacacaggtgcagctgtatgctccgaatgattcggaggcgcagcggttcgtgattaccgacgcttcgaccgtcatgccggaaggttcgacgcgtttggcctcgtccgggcagagcgcgatgacgctcggcgttgccgatggctcgtatgatgatggcgcgaagcttgaggtgcaggattggtcgaatgcggattcccagttgttccgcttcagtcgtgtgggcaacgggctggtcgagattcgcagcgtgaattccggcaagctggtggaggtcgcgtccggtaccatgacgaatggcgcgcggatccagcagtggccgtcgaatggttcgttggcgcagcgttggtcgttgcgtgacgcggggaacggcaatgtcggtttggtgaacgcgaagtcgggtcgtgcgatcgatgtgaccggcggcaatatcgcggccggtacggcggttcagttgtacgggtggaacggtacggccgcgcagtcgtggaagacttctgtcgcggagtcgaagcgtggcgggttgtctcgtctggcgggtgcgactcgatatgagacggccgatgcgattgcagctaccggtttcaaacagtcggattgggtggtgattgcgtctggcgagtcgttcccggatgcgttgtcggcttcggcgttggccggcgcgttggatgcgccggtgctgttgtcgcgtccggatgcggtgagcgacgctcttgcggcgcgtatcaaagcgctgggcgcgaagcgtgcggtgttggtcggcagtgagagcgtgttgtcgtcgtcgttggcatcgcaggtgaaggacctggtgtcggagcatgaggtgcgtcgacttggcggcgcgaaccgatatgacacgtcgctgagtgtgttgcgtgatgcgccggggaagcttggtttcgagaagtggtcggataccgtgatcgtggcgagcggcgaaggcccgtatgatgcgttgtcggcgtcgccggtggcgtaccggttgcaggctccggttgtgttgacgggtacggatggtctggataaggacatggtgaaggagctgcgtgcagccgggttcaagtcggcgctgctgatcggcggcgagaatgtgatgcctgtgaaggtggaatcgcagttgaagtcgttgtcgttgactcgtcttgctggcgcgaaccggtatgacacgtccgccgaggtggtggattatgcgttgcgcaagaagattctgaaggccgatggcgtggtgttggcgtctggagagaattatccggatgcgttggccggcggcgcgttggccggttcgacgggcaatgtgctggcgttggtgaacggcgcggacgcgcgttcggttgcgctggcggctgccgcccagtcggatgggaacacgacgatcgcgtatgtgttgggcgggacaagagtattcggtcagtggacggccgagcgcatcgccgccaaactcaacaagcacatccagtaagcggaagacccccggggtgcagttcatggcatcccgggggtcttccacactgcggcgtcaccgtcaaggacgattccggtgcatgtagctgattgtgttggcgtccacgaggaaggtcttgcggtcgtttttggcgatcacgtcgaggatgatgccggtgacgatgagcaggagcccgaccatgccggtgtgcacgaatttcgcggtgacgaagccgcacagcgcgagtccgatgacgccgatgatgaggccgagcccgccgaagaacgggaggggcttgtattcacggatcatgcggaagatggtgctcatcaccttgatgccgtcgcctacggtgtccagcttggagacggagccttcgggcctgtcgcggtactggatgggcatttcgaacagacgcaggtcgttgttcggcgagtggatggtcatctcggtctcgacctcgaagccgcgtgacagcacggggtaggttttgacgaaggtgaagctgaacgcgcggtatccggtcatgatgtcggtgacgtgcgtgacgaaggtgaagctgaacgcgcggtatccggtcatgatgtcggtgacgtgcgcacggaacaggtggttgatggatccgcgtacgaggcggttgccgaagttgtggaacgggcgcttgttttcctggaaataggtggaggagaggcggtcgccgatcaccatgtcgtagccttcgagaaccttggcgaccatcgcgggcgccgcgtcggccgggtacgtgtcgtcgccgtcagccatcacgtacacgtccgcgtcgatgtcctcgaacatggcgcggatcacgttgcccttgccttgccttggcgtggctccttgcgtaccaccgctcccccagccgcggcgatttcggctgtgcggtcggtggagttgttgtcgtacacgtacacgaccgcgtccggcagcgccgctcggaagtcgcgcaccaccctcccgatcgttacctcctcgttatagcaaggaagcaacacggcaacggaaggggcagcagtttcacgcatgcgccccactatacgcgttgactggtatggagacatcccataaggtcgactgatttcatcgccgctcgttgaccgattgccggtctataatgcgtatatgaatactgaggcaatttcgcaattggatgtgcatcggttcggtcctttcgacaatgattatgagctgacgttcgccacccccctcgatcaatctgattgtgggagataacggcaccggcaaatcccaattgttgaaattactgtactcatgcacggcggttatgcatgatgcggttgatgattccgaactgacgaagacgaacctgcagaagaagctggcttccaaaatcgtgggagtgttttctccggattcgttgggacgactgacgaatcgtcaacgtgggcggtccaaggccgtcgtcggcatcacatatgacggcaagcagcatccacttcggttcagtttcaccacgaattcgaaaagcgaagtgaagatcgacagtttgccggagtcccgcgtggaatccacgccggtatttcttccttcccgtgaactgatgtcgattttcccggggtttgtgtcgttgtacgattcccgccagatcgcattcgatgagacatggcgggatacgtgcaatctgctgggcaggacaccgctgcgtcgtactcccggtagcgatgtggataaggcattgcagcctatcatgggtattctcggcgggaaagtggacgagtccgccggcaagttctatctccatcgaagtgaaggcacgttcgagatgccgttggtggctgaaggcttgcgcaagcttgccaccatttaccgtttggtacagtctggcgtgctgttgaatagcggcttcctgttctgggatgagccggaggcgaacttgaatccggccagtcagaaagccatcgtacagatggtgatcgagcttgccaatgccggtgtctaggtgttcatgggcacgcatagcgcgttcctcttgcgtcagttcgattatgagtcccgtaacaatgccgacgtggcgcagatcggctatacggcattgcggcgtaccggcacgtcgatagacattgctcaaggagcttccttggacgatttcgatgaggagcatctgcagacgttgaaggcggaatatgagcagaccgccttgctgctggacgaatgatgggcgccccgatggatgatatgagcggcaggtgattgcggtgcagacgttcgagcaggataccaacgtgtatgagtttccggacgagtgcgttgtaatgccggatttcgataagaagccgttctttaccaagctttccggcgcacaggcgattcacgccaaaggatgcgacatcatcgccattcctgatgaagtgacgttgtatctgatagaagcgaaggattactcccatagcaatccatcggaaaaacctccgaaggctccgaaactggcgtggaccatagccagtaagagctttgatacgctggcgtgtctcatggtcggagccacgcggtctgaggatgtcgaaacaacggatttctgccgcaaagcgcttgcctgcacgagaatcgtggtgtgtgctacggtcgagccgtcacgtagagtggacgttcagaacaaggccgataaccgctatatgatgcaattgcgggaatgcctgcgtcgtgaggccaaagggctggtgaagagcgggcgggatattttcgtgacgcggaatgcggaaaccgacaggaaaggcaaattctggacatcacattgggcgacatctcacgactgatcgttgtgttgtgaactacaagcaggcgattgatgatgagaatcagcgaagtcgaggtgttgagaggagatgttggtgtgtagagtgattgcgctggcgcggtcgtcgcggcgtgtgatatggctgccggtgtgcttggggctggtgatgggcgtcggcgggtacagcgccacgcgtggcgcggtcgcgttcggtgatcctgcgttgtacgtgcagtgtctcgtgtatgcggcggtgttctgcctggtgttcccgttgctgttctcgttgcaggaacgattcaaggaacggtgcgtagagcggacaggtgaaccgggagcggagccgtctgcgggaactgtcgagacggtcgccgagaccggagcggagacgcgcgccgtaccgcgtcgtgcgttggtgcggttcgagcatgtgctgcatgcgccgaacctgctgcgtgatgcgtcacgcatgttcgtgtgctgggtgccgtatgtcattctgttgtatccggggattctgtactgggatacgggcgaccaggtggcgcagttcttcggtatggctgtgttcggtcaggagccggggcagatttggaatcatcatccgttcctcgacacgtacttctatggttcggtgatttggctgggacatgcggtcagtggccattacgaggtgggtgtattcctgttgtcggcgttgcacgcgtttctcgcatgcgttgccgtaagcgcgttgctcgcgtatcttcgcgggcgtggattggcgcgcgggccgctgtccggaatcacggccgcgttctgtttcttcccggtgttcccgattatgttcgcatcgatcgtgaaggatacgacgttcacgatcgcgttggtcgcatggttcgtcatgtatctgctgctcgtggattcccaactcgcaagaatcgtccgtcccgggttcctcatcggtttcgtcgtgctgttgctgctggtggcgctcacgaaaagcgtgggcatgtatgtgatggtcgtcgccttgctgctgctggtggtcggccggtacaaggcgcggttcaagacggtctgcgtggccgtggcgattggctgtttcgcgttcgtcagcgtggtcttgccgaagaccgtgttcccccggttgaacatcgttccgggcgagcgtcaggccgccatcgtcgttcctatccagatggtggcccgtgtggctcatgcgaatccgtctgatgtgatcgatggggagaagcaggcgctcaacgagtatctgcccatgagctgggatgagatgggggagaagtatgtgccgttcaccacggatccggtgaccggttatgcgatcaaggacacgggcagcgtcgtcgatttcgcgaaggcgtggctgtccattgggctgaagcatccgcgtgcgtacgtgcaggcgttcatcagcgtggaatcgggttggctcgcgttcaacggcgcgccggcgaacaatgtggagccgcaggcgccgtacccggagatcgccctgcagtaccagccgcttacctcgaacgcgttgaatcccacgacgttcggcaagctcatgcccaatgtggagccgagcagggcgcaggcggcggtcaaggggctggttcgcgtgttgcaggacattccaatcgtcaacgtgctcatgtacctcacggtgtgggcgctgattgttcccgtttacctgctgtacgcgttgatacgccggaatcttagacgcgatgatgtcatgcggttcgtgccgtattggctggtcatggcgttcctgttcctatgcccggtgaccatccaattgcagaacgaccattcgtctcccactcgctacgcgttctcgatgctggtgatgggcgtggccatgatcggcgtgagtctgctgggaacgaaagcagacggcaacggaccgcaaatccagcagaagcgaggcttctgttgttttcgtgggttagatcgtgggttgtggtagtcggatgtcgagtccgccgcagcggagcacgacgagggcgatgaggttgctgacgtggtggaagccgtaggccatgcggatggtgccttgattctgttgttgaaggcctcgagcctggcgttggagtagcccagctggatcgtgcgcacgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcaccctcaagaacttctccgacgtctacccggacaagtttaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggtcaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggtaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggctgactgagtgagcgagttgctagcgtgcggttttcacgaaatcagccttgacttcgtgaaaaccgtacgctgagttggagtaagcgtgcggttttcacgaaatgaaccttgatttcgtgaagaacgtacgctgagcgcgactcagtgtacggttttcacgaagtagggctttatttcgcggaaaccgtacgctgactgagctacctctagccccctctgatgagggggatgtcagcgaagctgactgggggagagacttctcccagacgcccaagacatacaagaaagccccgcaatgatatatcgatcgacgatatatcattgcggggctttcttgtgttgaaagaagagagggggtatcaggcctcggccggagcttcggctgcgggcttgtcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccgcgcccgtctgcccttggccggctcggcatcttcgcggcgcgtggaacgcatccgagaccttcgatacagtggactgcatgcatattcctacacaacgggagattcgataccagtgggagcgcggtggtccggtgatgacctgggcgctgattgttgcgtgcgtggcagtgtggctactggaggtattgctgggatttattgccccgggcctgaggacttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggcttgatatggctgtaaaaaaaaacgattgatgccgggtattgcggaacatgcagtgcccggcatcaatgtatgtgcggaaagcgacgatgtggatattagcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgccaccaacgatacggccgatctggtggagcaaggcgtggacgaggccaaccagctgcagcaggacgtcagcgatctgaccaaacaggtcgccaatcttacggacgcgctcaaggccgatggcaccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgccccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaaccccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcgccgattcgatggctgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatggcaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggctcaaggtctgcggccaagacaacgccgtggccaagtccgccggcctccagcccaaagttacgaagtagcttttccgcgcgcggcgatactctccccggaatgtgtcgctagaacgaggcttgcgtactggttttgcgacgcttcccgggattgttgcgctgggatagctctttatacagcaaaggggaggggcgcagaagcccttcccctttgtgttgcgtgtatgtgttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacgggtaatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggatgtggaagcgttgcacacctcagggatggtgacggtgtcttccgaggacttgttgccggagccgttcatggcgaacacgatgcccacaatgacaagcactgcaacaatcgctgcgatcaccgaaccgatgatgatcttcttgcgcttcttggccttggccgccgccgcacgctgctgcgcacgggactgcaacgccgctgagttggcaccattggccggtggaatctgctcgaactgaccggtcaccgggttgaatgcttgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttggccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgtcggccatttcggtctgctgatccagcagacggcgttcgatgcgtgccagcgtacgggacaccaccagcgcgtctttcgggcgatccaacgggtccttggccagcatcgacatgacaaattcgcgtaactggacgtccaccgagttcggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccttggccggtggagtagctcacgccgaaatcggtgatcttcacttcgccggtgtcggaaaccatgatgttggccggcttgacgtcacgatgaatcacgccgtgcgagtgggccacgaataggcctcgcgcggtctgaatcagaatgggcagcagttcgatgggatccatcgcgcccttgctatggaacagatccgccaacgatttcgaggggacgtattccataatcagaaagccgatgccgtcatgctcgtagtattcgaacaacgcagcgatgttcgggtgcgccagattggcggaattatgggcttcggcacgcaggcggcgcaacttggcctcggcgttggtcacgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtatacatctgtgttatgcaccaacaccgcgacggcgatttgcggattgtccgccggcgcgaaaccgatcacccagccgtcgatggcagagttgtcggtaccgatttgtgcggtaccggttttggccgccaccttgatgccgtcgatggccagctgcggattggcctcggtcaccacgctttccatcatcgtggtgagcttgtctgcggaatccttgctgaacgcgttggccatggtttgcggtttggtctgcgaaagtacggtgagatcggcggcgcgcacacgatcgaccagcgtgggctgcatcagtttgccattgttggcgattgcctgcgcgaccatcgccatctgcaacggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaacgcggtattggacgaccatgcgacggcctcttgcagggagatctgcccgttgacgccatcggcctgtgcctcgtcgttcggcaactgtgtggcggttcccggcaaggtatagctggcgcccgcaggaatcttcgtgtccgtctgataatcgccggtttccagcgcagccgaggcgacgatggtcttgaacgtggaccctggcgggtacagctgcgaggtggcgcggttgattagcgggctattttggcccgcagagagttcgttgtaggcctgagacgcggctttggcgtcatgggtcgccagtttgttcggatcgtagctgggcgtgctcaccatggcgaggatacggccggtgttgacttcgatggccaccgccgcaccatcgcgcgtaccgagctgatcgtaggcaacctgctgcagcttggggtcgatggaggtttcgatggacgcgccctgatccgtagcgccggtgagcatggccttggcccgctgccagatcaatgaatcggcctcaccgttgagcagcatgctgcgggaggcttccaggccgcgatcggcggtctggttgatggagaagaagccggtgaccggagcatacagcggaccgttggaataggtgcgcaggtatttgaacgcgtcgttgaccggctcggatttggccatgaccgtgccgtccgaggccagaatggcaccgcggtaggcgccgagctggtggtacagcgaacgggcgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtgccggtaggcgtgtacggttcatcggcttcggcatacgacggagtggtggtatccacgatggggtcgtcaaacgattccgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgaattcgagatgatgatgagcagggtcgcgagaatatagttggcgatcagactggagccaccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctgaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcagaccgagcatcttcttaccgcccacggccagctggtcgcgatggtcgaacaggtaggcggcgaagaagaacgcaaggaacagcttggcgaactcgcccggctggaactggcccagtcccggaatcctgatccaaatgcgcgcgccgttcacttcctgaccgacaaacggcagcatcggggcgagcagcagcaccaagcccaccaccatcgacacgtaggagaagcgccgcagcacgcggtagtccttcaggaagatgatgagcagcgcggaaagcacgatggcgatgcacagccagatcagctgacgttgggcaaccgcccaaccttcgctctggtcgatgcgggcgatcatggtcacgccagtggcggtcagcagtagcacgcaaggcagaatcgactggctggcgtacggctggaagcgcacaatcagcccccacagcaccagaaacagcaccacgaccaatgccagcatgccggcgtattgcatagggaattcgccggcggtgcgctggaacatctggatgaacgccaacgcactgattgccatggcaatcagcaacaaagaaatctgacgtagacgggtagcgatcattgagaatctcccgtggccgcgttatcggccgctccgataccggatttatccgaggaatcggatgagcttgacgaaccggacttgtctgacgaggagccggactggctggacgaatccttggtgccgtccttggaatcgctctgggaactgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggctacggtgccgttgctatctcccacgtagtagtgcgtctggctccacgtgtacgcgccccagccggcgccggccaatgccagcacggcaagaatgcaggtaataatcaccgcaagcttattgcggcgcttcttggtgcgcgtggccttcttctgctcgacctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgcggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcagatcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacaggccgtccgagcacagcagccaacggtcggcggggtgtgctcggcgaatcgaaatatccgggcgcgggtcaatgtcaaagtcgccaagcacgcgcatcacgacgttgcgctgcgggtggttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtctccatcatgcgggagatcgtctcgacgttgccaccggtgtcgtcctgctcgatgtgggccagtgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcagaatggtggggcggttgatgcgctgctggttgaccacggtgccattggtggagttcaggtcttcaatggcccactgcccggagcgcgtgtcacggtagacacgggcatggtgggaagacacgaattcgtcatcgagcaccacggtgttcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcgcttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccgggcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatttgtcaggccagcgcgtcgcgcaggaaatcgcgctggagggtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgtttcggtagtagacatccgggtcgaggcccagatagcgctcggtgtagtgcgtgtcgtacagcgtccagtcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggttcggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgatcccaatccacatcggcgttgccggtgatgcctgcgtaccggtcgttctcatcgaacgccagcgtgatcacggtcagatacacgtcggcattgcgggtcagcgcgcgcgggtaacggcggccggcgtccggcttctcggggtcagccggatcgctgatgtgccaggtcggctcgtcggcggtgtcgaaggactcgaacagcacgtgctgcgaatccggggcccaccagaagccgtcgtatcggtccatctcctcgccggccacgaactcggccagaccgattttccacgtgttttcggccggattgccgtcctcatcctccacgctcacgccgtagacggcggtgatgcggtcacctagttcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacagtgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgagggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccgacccgctttagatggcgggagagccatggaattatgggcataatgtcttctctccgccgccgcgccgccgtggttgcggccgcggtatgcgccggcgcgctcgcgttgaccggttgcacggcgttcaataattccgatgacggcacagcggacggcaacggcgcgtccgccaccgcgcagaccttccagccgtccggcggcaaaccgaccgccaccctgagcattgcctccggctccgagaacaaggaagtcgccactgccatccagaaagcggccgaccaatccaacgtagccgtgacgatgcactacatgggttcgctggagattatgaacgcgctcaaggccggcggccagaattacgacgccgtctggcccgcttcttcgatgtggatttcgatgggagacgccaagcacatcgtcaaagacgcggccagcacctccaccacgccgatcgtgttcggcatcgccaaatccaaggccgtcaaactcggctgggctgacgacaccggtgccgccaagcccgtctccaccgcggacatcctcgccgcggtcagcgacggcaaactcacgttctccatgacctccgccacggtgatcgacagcgcgctcaacgtctaccagaccgcgctcaggaagcccagctggaccatttgggtggtcgattactccggttcgatgtctggagagggcaagaacggcgtggtcaaaggcctgaacgcggcgctcgacccggaccaggccaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcaactcaactcgatcgccatgctcaccaagcaagtacgtgacccagccgtcaaagccgaagccaacgacttcatcgccgctaccaaagattgagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggtacgaatcgaaaccatcgaggcgctgcaagtgctcgaacagaccgccgccggcgaactcagccgggcggtaagcgccaagacgttgggcattacggccgactccgacgccatccaacggttggcccgcatggatggatacgacgacgtcgcaccttcgcctgtgccttcctcggctgctgatgaaggacggcatgcgcccagtcagactccatctggtggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcgccggccgaaccgaccgaacaggtgagcatcaccggctacctgggcggcgagaaaatcggcctgttcgatgacgccaagttcaaggcgctcgccgccaagcaaggcattgccatcgactatcgcaaggccggatcgctggccatgatggatgcggaccggaaaggcatgggttacctgttcccctcctcgcgcgcggccgtcgaatacggcaatgcgaaaggcgtcaaggcccccccaaagcgacatcgtcttcaactcaccgattgtgctatacacgcacaaggccgtggcggacgggctcgtgaacggcggacttgtgaccaaggacgattctggcgcgtaccacatggatatggccaaagccgtggacgcgatggtcgccaacacaacatggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggccgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggttctcgacctgcagaacaaggccgacgatgtgaccaacaagctgctggcgcgtaacgcggccgccctgcacaagggtgcagtggacgcggaaaaggccaaccagcgttccgtggtggaaatcgacacgctggagaagatcaacgccgaactcatcgccaccctgaaggagaccgtgcagatccagaaggaaggcgaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcaaccattcccgccgcaatttctctgtgggcataatcccggaatgattgccgcgctcgggaattgggtgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgaccaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgcgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagcttcgccccctctgacgagggggctcccgcgaagcgggtgggggagagataaatcgtaaccaaaccatgcttcccacgccgtctgccctacgctttcaacgccgactaacctgacagacggcgggaaacatagccaatgcaaatgccgggtagggatttaccctacccggcatttggctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccgttccggcggccacgtcgtatccgcgcgcgccacgaccatcggcctgatggcaatcctgctgtggagcttcatggccggcaccgtgcgcatcgtctccgaaaacttcggcgccacgcttggctcggccctgatttacacggtcggcggcatcctgctgctgatgttccggcgcccggccccgattcgcgagttccccaagaaatacctgattatcggcggcctgttgttcgtattttacgaatcgtcgatatccctctcgctggggctggcctctaccgacgcatcctcggtggaagtgagcctggtcaactatctgtggcccacgatgatggtgctgctgtcggcgggcgtatcccatcgcaagcacgcggtcgtcaaggtgctgccgggcgcgatcgtggccactgccggcgtggtgttggcggtcggcggtaattccgggctcgactggcatgcggccgtgcagcatatcgccgccaaccctttgccctatgcgctggcgttcgtgggcgcgctcgcttggtcggtgtacgcggtgttcacgccagccatgagtcatggggtggacggcacttcattgttcttcccctgcgtggccgtggcgttgtggattatccacttcgcgtccgggcaggggtggccggccgagccgccgagtctggtcgcatggctgtttgtgttgattgccgcggcggcgattggcggtggttatgcctgctggggatacggcattctgcatgggtctatggagcggctggctattgcgtcctatgccacgccggtgctgtccaccggggccagtgcggtgttgctgggtttggcgctgtcgctgccgttttggtgtggcgcgctgctggtggccgtcggatcggcgcttaattacttggtcagtgcgcgcaaatagcggggtggctttgctcatggggcggtaataatcccatggggcggtaaaaccctcatggggcggtatcccaaaatgactttattctgcggtttcacaatttcttcaaaccgccccatgggccttttaccgccccatggataaattaccgcccgatgggcagcagcaacttactcgccgcgacgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggttttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgccgacactggccttgaactgcgggcgccagaccggatgtgaacaggcgctgaacggagtctggggaaaccatgagaactcgcgacaatttttgtgaaattgggtgacgctctatgaatcgcgcgctagtgttgcgtgagcttacaaggcgaggagcctggagcgcgggggtgaaggatgaagaactccgtttggaaaacgttcatggaattgtctctggtccgcggaatcgtgccgcggaccgtgttcggactgaccgcgatcgcggcaatcatactgattattgggctggcattgagcaagagcaagaagcgcggccgcctgcacccgctgattgtctcgctgattgccgccgtgctcgccggcgcggctggactgctggttgcatggctggtgtccgacgtgtttatggtgttcggcgtatcgctgggctggccggtgatcttcaccatcgcgggcggcatcgccggcgtcggcttcgtgatcgccgcagccgtgaccctgcgcggggtccgccgtgcgctggccgtcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagtgtcagcgactggcatagcaaggcgcggaagggcagcctgccgtccatgcccagccaaggcaaggtgctcaccgtcgacattccgaacgccaaatccaacttcacggcccgcaaggcgatgatctacctgccgcccgccgcgctgtccgaccgtccgccggccttgccagtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaagtcggcccgcatgtgggcgatgggtgggttctcgcaaggcggcacctgcaccacgcagctcgtcccgcgtcatcccgaaatctacggcgcgatgttgccggtggacggcgaactcaagccgaccaacggcagcgtcggcaagatggtccaagagtatttcgccggcgaccgcaaggcatacgacgaacaggtgccggtcaacgccatcgcctccagcggcacatctgagcaggcgctgttcaccggtgctggcgaacgggacaaggaatcgattagcaacatgcgcacgattgccgccgccgcgcgcaaagccggcatggaggtcaccgagctgatcgtgcccggcgccggccacgactggcacgcggtgcaggcggtctggcggcccggtctcgactggtttggcgaacggaccggcttgggcgagatggcgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgtgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcacgccgaaaccggatggcactggctgcgcagcacctccttcgaggcgcggcgcatgttcgcggccatcgccgtggtgctggcgctggggccggtcatcgccatcacctcgcataatcacgcggggccgctcagcacagtcggcctgctcatgagtccggtctccgtcgacgacggcacgctcgcgcgctgcctggccggcgccacgcacagcggctgcttcctgcaattcgacctgatgcgcgcctcgatgcccggcgcggtactgcgctcgctgctgcccaccgccgtgactctggtgctggcgtggggcctgtatcgcggacgtcggttcgcggccacctgcgccgtggccatcaacctgttcacggcgggcgttgccatcgcctattacctggtcgtgccgctgagctttgcgccggatggcatgacctccctgctgcagcacggcgcaatcaccgcctgcgtgacgaacaccttgccaccgctgatcttcgccatcgccttggctgcggcaatgaagcacttcccgattcgcgtcggctggcgccggctgatcggcggcgtcggcgccatcgtgctggttctgctggcgtgcgccgccgtgtacctgatgtacggcattgcccagccggacgccttctcgccgcgcgccacggcctcgtcgctgttggccgaactgccggggtgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagctactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggccggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtggagttcatgagcctgtccgcggcacccttggccggcatgaaccccgagcgagacaatgcccgggaaggtggggtggcggccggcgaaggcacgcaggtgctccaacacgcgctgcagatcgtggccgactggatggagcccgcctacggcttccactcgctgttcaacttcaagcgcaagttccagcccaccgaagcgccggtctacgtgtgctacccggacccggcggcgttgccgcagatcgggctcgcggtggtgcgcgcctacgtgcccagcgtgacgcccgccgaagtagccggcatgctcagcacgctgcggtcgtgaaggtgtgcacacgggtacgcaggctagccgattcgagcctgagacggggtatctgctttcagagaggtacatttggcctcttgcggacaactaactgccttcaaagaggtacctgaactctgaaatcccgagtatgagcgttgcaatgacggcgtttgtactcgggatttcccgtattcggtacctctttgaacggagaaagcattctgcagaagcccgaatgtacctctttgagcggcgaaagcccagcgagaagggcgcagaaggcgctatctccgtttcgaggggttgatttggcctctccgggaggtctactcctgcttcgaggggctgatggccgagtattcacgctccaaaatcggcggaatggcgttgacgcggatgggcttttacatgcggtctagctgccgaccagccccttgaaacgggagtagacctcctgcgaaggccgaatcagcccctcgaaagcggttttgccggtgcagaggtgtcgttgactgcatcgcgagccgcctcgacgtagtaacgtggggcgcatgagcgaacgtaacgaacacaatgacggaaatacgcaaaccgcatacttcgccggcggctgcttctggggactggagcgctacttccagaacgtcgacggcgtcacggacaccacggtcggctacgcgcaatccaccgtcgaatcgccgacctacgagcaggtatgcgcgggcggcacggatgcggccgaaaccgtgaaagtcgagtttaacccggcacaggtcagcctgcggacgctgacattactgtttctggaggtcattgacccgttctccgtggaccagcagggcgaagaccgcggccggcagtaccgcactggcatgttctacacggacgagacgcagcgcgccgtgtatgtggcggccttggagcagctggtcgaccgccagccgcagcgcccggccgtactggtcgaaccgctgcgcaacttctacccggccgaggcacatcatcaggactatctggtgaacaatcccggcggctactgccatgtgccgatcgccgcaatcgcgaacgtaaaacgccgtcagaagtacgtggaacgcatctgggatctgacgcttgagcaattcgcggtcacacagaacgccgctaccgagcgcccgttcgtcaacgagtatgacgaggagtttgagcccggcatttacgtggacatcgtcagcggcgagccgctgttctcgtcgcgagacaagttcgattccggctgcggctggcccgcgttctctcgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcgtaaccgtggcatcgccgccacgttcgtgtcgcataattgctgcccggccacgtcataattcgccgtgccgcgtgggagcgctgtggcggctacgacgagtcgatgcgcggcgacgccaccgccagtcaagccttcatggcccaccccacctacggcgacggcggaatggccgccgccgtacggttgaggagctgatggtcagccggctaaatgccgatagagctctggatcgattggccgggccaaacgcaggaccgacagggtgaccttcacactgccctgtccggttgcgtcaggcttggtggtgagctgaggattctcaaacgcagcgacgtggccaacgtagtagtacttgccatcggcctcttccgccttgcgcatgacgaatagcgggacgaaatgtgtgtggtcccaattcgggccaatgccgctaagcgcccatcggaattccggagactgcggagtgcgtccgttcttgctgaagtatttcatttcctgtgtgctcaggaattcatcctcgtattggctggccgcgtatttcacgaagatgggcatggtgttggtttccttgtcgagcaggtaaccacccacgttttgcggagtgttttccttcttccatccgcacaggcgcatgacgtcagccatggaatatttgcgctcgtacaagaacatgtggtcgaagacctgttgcctggcggcggcctcgcggaacatatctcggcaattggccataccggtgcgcaaagtgtccgcgaagaagatgcggaacgttcggttcgtggcaagtatgtcggcgaatctgctgctcaaccgatatgcggtgtcgcttcctgtgccggtgctgttcaaggtttcgaccaatggctggttgccaaaacgattgcagttcgggccggtgaaatatgaataatcgagcacgctgatcgcagagtcgaattgcgcgtctgaaccatcggccagcgggaattcagtacgaatcgcatcgagcagttcgctgcggccgattgacgagcccgcactccaatgctgaggtacgtcgtcgtcgagccgttcgctgacgaaatggcatagctgagcaagaatgaccaattcgtgcggtcgcaatccgggcagcagcagctccgctgccatcttgagtatcgcgtcttcaacgtcggtcaccggctccaactgatcctcaaatgtcgcttcatgatgtttgcctttgcccaggcttttttcacgggaacgcacgaaatcaagatagttgctgcgcttcgatgcgatggtatacggcagtgaggggtcgtagttatagatgtccgtaagcatggggatgcggcccagctcgtaacggacttggcgatactgttcggacagctttttcatgtcggaccagtcggcggtgtccaaagacttaaggatgcgctccttggcgatcgggtcgaaactgatggacgacaggccgattgactttcgctgcaggttcttgcgagccctgtcgcggtcgccagtgttgccgtataacgccaccggaatcagatagttgttgttgtaattgccgatgaaatcgataaccacaacgctttctttgtgagggaatttgcgcagtccgcgcccgagctgctgcgtgaagataatgctggattcggtgctgcgcaacatgacgatttggttgacggcgggaatatcgactccctcattgaacatatcgacagtgaagagatagtcgagttcgccttcagtgagcttgcggacgtattcgtctcgctgcgcttgggacacgggcctgccgtcatcgtccgtgctggtaacggcagcggtgcgataggggcgttcatcttgttgattccactgctggttaaacagctgggacagcttatgggcttcctcctgtcggctgcagaacacgagtccggtgaccggaatgttgaactgcccatattcctgcaacttgtcaatgatgtagcggactcgcttttcggtggcaagctgctcgatctcgtacttgagctgtttcgagtccttcgcatcaagacccttggagacatcgagacgatgggcgattccattcggatcgtcgtcggagccaaggtattccgcaacgccgtagtagtggaatggacagagcatgttctcgtccaacgccttttgcaagcgaatttcgtacgcgatgttatgcccgaatagctcgaagatgttgatgccgtcggtgcgctctggcgtggcggtcatgccgagcatgaagtcggcatctttgaaatgattgatgacgcgctgatatccttcggctccagcgtgatgaacttcgtcaaccagaacgtagtcgaattcatcggatttgaattgcgccaaaacctccggctgccgcatcgtctgtaccgtggcgaatacgtagcggcggtcctgttgcttgctggtgcctgaatacaatcccaattcggattcatcacagccgagcaccttttggtaagagttcattgcggtttgaagaatcatctgctgttgggcgatgtacagcatgcgcttcggctggcattcgcgtacgtcgaatgcggaaaggtacgtctttccggtgccggtggccgacacgataattgcgcggtgctcgccttgttcacgaagtttcttgagattcgccaacgcctcctgttgcatggcgtttggctgaatgtcatgcccctcaaacgactgcagaatctcatgacgcggtggggcgtatttcttgaaatcttcctcatactgtttgatccactcttcggtcagcggaacggaatcggccacctgtgagtcgatttcatcctggaactgcccgaccagctctccatccgccagcgatgagactttgagattccattcgcgttgcgtggtcaatgcggctccagtgagattggaactgccaacgtacaggtcgtaatagggcgtaccgtctttcatgcggcgagaaaagatatatccctttggatggaatggctgtccttgagccattgcggccactgaggcattgcgggagccttcccacacgcgaacgtcaacaccagtggtgttctgaagatgcagcagctcccagaatgccctgggatcgttgaaatgatttttcgttgaggtaatcagtgtgcccgctcgggtcgctgtttcatggtgacttctgaagtcttcaaataagctgagcacggcctcagccgagacgaatgcgacagaaatgtcgaaggaatcgctagtagccaaggaattgccgatttcctcgcgcatggtcaatccaccggggcgatttgcgatgagggtcggcttatattcgccgggagcatctgagcgcggctcgatcagacctgagatgacatcttcgaggattgagggtgtcgggccaggaccactatgttgcgtgttggccggagagcttgaggtgctggccagattgatagacatgttgtcttgttcccttgcgattcgaattgtttgttgatgactgcatgactgcatggctgcgctatggcgcattcatcggagcgtcagctgtttgctggcgataatcgcgactgcttcgcgatctaccggagcccagttcaatgtcggcatatcggcaggattcagccatcggatatcagtatgctcggtgagatgcggtgtgccggcgatgaggtgacagacgaatgtagtgagccgtacggtcccaaagtcgtaggcgtattcgctggtgcatacttcttccgcgacttcaacttcgcataacagctcttcttcgatttcgcggtgtaaagcctgccgcgctgtttcatgaggttcgattttgccgccggggaattcccagtatccggccaacgacttccccggaccgcgttgtgcacatagtacggtgccgttggtgacgattgcggctcccacgacgttaatgattttgcgttccggatccatgaacaaccaggatacaacgcttcaagatccacaagcgatccacgatcctcgacagtttcgcaagaacgatcctgattcaatcggaactactggaatcgcagtgttctagggcatttgtggaacgaaaagaaaggctgatcaatggtgaatgaacggcagaccgatacgtgtgcggacgtgatgtacaggcgtgaacggcagagaggctgtggcgaagcagggctggacttcgcccctttcattccctcacaggatgaagttgatcagcagatgagcgcattggatgacaagcttgtgtccaaggctcaggaacaatacgcgaaccgagaaatctatcctttggacgagtgctatcagctggacgggtcgacgtttatctcagccgaggcgtttgaagagattcttggcgacgagcaaacgcattatatgcccgggttctaaatagaagtgcaacaccttgtctagggttggaagtgttcgaagtgtatttcgtcaagtcggtgtttcgtgtttagtcatgtatttttttcgggtttaggcagttgcatgcattttccttatttttccggttgcgcggaggtgttcctgccgaacatgagggcctcactgacgcggcggctctggccggtgaactcgaggagccgcccgtggtgcacgatgcggtcgatgatcgctgcggcgagtttgtcgtccgcgaagaccgtgccccatttactgaactcgatgttcgtggtgaatatgatgctccgtctttcgtagctgcccgcgatgatctggtagagcaggcgcgccccgtcgatgtcgaagggtacgtagccgaactcgtccagtatgatcaggtcggcacggccgatgtcccggagcatcgtctcgagcgtgccgtcgcgtttggccttgcccagctggaggacgagctcggcggtctgatggaaccgcacgcccagccccatgtcgatcgccttcatgcccagcccgatcgcgagatgtgtctttccgcgcccggtcttgccgtagaacaccaggtcctgcgcgcgcgggatgaaaccgagccctaggagctcatcgagcatgtagccgtcggggagcctgacgttcgtgaagtcgtagccgtcgagacccttgacgacggggaaccgggcgcggcgcaggagcctgtcgtgcttcgcgcgttccctgttcgccagttccgtgtcgagcaggcggtggacggcgtcgacctggcggggcgtggcccagccggcgaattcgtcgatgctcgccttggagatgaacagcttgcgggccttctcgtagagcccttcgtccgtcttcgtgttcatcgcccgccttcctgcacgccgacgtccgcggtgaacgcgatgtcgtattcactcagatccggcctgtcatcgtcgtattcgatacccgccacgccctcggcgagcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggtcctcgctgttcgtgctggcctggccgtacgcccgaggatgggtcgccagatgcttgcccgacgagtcgaggacctcgacctcgagcgcgcggaggcccacgatcacccctctgcccgcgttcgcccggtccgcggaataacgatgccgtccctcgagcgtgaccacgccgtaccggtcggccttcatatgccgccacgtgaccacgtcgaaacgcttcagcaatacgtctggcaggaataccgcattggccacctgatcgcggtactcacgcaccacagccgcccattcattcgctggtgtatccggttgggcaaggccggcctgcaccaatgcttggaagcgttgttccgtgttctgttcttcagcaaaacgggccaacatggtcaaatccgctgcggacatggtgaatcgtggcgtggccagcaagcgcatcagcgatcccgtatcggtgtggtcggcggccacgtgcagcaacgccatcagatcgcggatttccggacgttccaacagcgcggaatagccgaccacgaatgtggtcaatccggcctgttccaatgccgcctgatattcgggcatatgtgatttggaccgaaacagcacggcgaccggcgctttctgttcgcccggcatctgttcctgttgttcggctgcggaacggtgccgtgcgatggccgtcttgcagaaacgcactacggcgtcgatctcctgcccggccgtggcgaagcccagtactcccaatgttccttcgggggcatcaggcatggggtcgagcgatgagacatcgacctcacgcatcaatgagctggaaggacgcgacggattggagcgcaacggcagcgtgagattattggcggcttcgagcactatacggctgtttcgcctggtgacggacagcgggaatggcttgtatccggcagacaggtggaaatcttgctggaacatacggaatgcaccagggctggcaccacgccatgcgtaaatcgactggaacggatcacccaccgcgttgacggcggacctctgtgacgcatccacgtggaacagtgctgccagcagagcggcctgcgtggtggaggtgtcctgatattcgtcgagcagcacgtggctgtacctgcggcgcgtacgctctccgatggaggggaagcgctcgataagctgatacgcggcaatggtgaagtcggagaattcggccatattgcgttcccgcttggcttgggcataggcctccaccagctggagcagaatatcgcgtttgcgtgtggtctccagcagcgcaccgcaatgataggtgcagcgggcgtgcaaatgttcggcacggtcatcgagcttggcttgccagctggcgtcggtatctttcttcagtcgtttgatcttggggattttcggctcgtcctcgggcatgggttcgtctgcaacggcttgttgcaatcgattgatgaatgccgaatcccattgccgtactcgattgatcgcatcatcgaagctggtgcagccggcaccgatcatggcactgccaatggcatccgacaacgccagaacacggttcgccaaactggagaaggcgccaaaatcctcactgaacgccagatccatgtgactgtcgatgacttcggtggccagttgaagcgctccggctgcgctcaatggttgcgtgttctgatcgaatccgacaagcagtccatattggcgcacgatggtctggaagaaggcgtcatacgtgaaaatggccggcttgaggaatgcccgatcagacaccgtggcggtcgtagagcccgccatatcaccggccactgcggcggagacgcgttccagcagttcgcctgcggccttgcgtgtgaaggtcaggcccaggatgcgttcaggtgccacacctcgattgataagcgcgatgatgcgttgggtcatcgtaaaggttttgccggaaccggcaccggcaaccaccaatacgtcagcatcgactggcgcatcgatgatggcggcctgttccgcactgggagtgaacgtgctcatgcttgcctcgtttcgaaaatcgtgtcgatctggcctgcacaggcagggcagacgttcttcatacggcagaatccgatatgggtgtcttgcggatgggcctcgatgatggctgatctgctggccgccgcggcatagaatacgcgggcgatcatggtcagcgaccataacgtctgcgtaccggcgagcgcggcgaattgcgcccacgcttcggcactcacaccttcgggaggagtagccggatctatggcgggtatgtcgaagaaacggttggggtctttataccagtatcggggcgtgaacggttcggcattcaacgagccatcagtgaacagcggcggctggaaggcaccttccggagcgtagcttctggctggtgccgcattctgcccgacatggaatagcacgctttggctgatatgcggcattgcggcaagtgccttggcaccgcgcggcccgtcttcggggaacacgaggccaagctgatagcacacgagctgcaaatcattgaaaatctgtttgaccgtgggcgttctgcctgttttgtagtcaatgaggcgaatgcattcgccgccgtctgcgagtacgcgggtttccatacggtcgatgcgcccggacagtctcacggtcagatgctcgtccatgccttccggccaccctccgaccagtgctcccatcagacggaccagcgtgttccgaccgattgggtgcaggccgggcacggcattgtatgcgtcgagtatgtcacgcacatcgaatcgtgcggcaaactcccgttcgcattcggcaccggccaatgcgccaatgctgaagttgctggagttcttgccaagatacgtttccggatcggcgtcgctgcgcacaaagtaatcggcgatgttgcgcagggtatccgccgcggactcgtccttacgggtggcctcatagcggttccgggtgtcggctatggcattcggatcaggacgtttgctctgatagatggcattaagccgtgccgagacagcctcgatgcgacgttccgtgccggccgtggagtccaagcccagtgcggccaacgcctgggcattgtgggaaagatggtccagcccttcctcgctgccttgctgcgcaaccgcatggatgagggttccgaaactggtggccacggagctggggcgaggaccggcgaaccggttctccagcatccagcacaccgggcacgcccataggctgtcgaccgccgatggagataaggtgaccatgggcgcggcctgcgcatccgtcttgcctttccctgtttggataccgtcaggctgtacaccaccagatgacgcgctgtcggatgaggcactgtcagatgaggtatcgccagatgacgcaccgccagatgacgcaccgccagatgacgcgctatccgattgggccggcgattccacaaacgcccagctctgcggatttgcggcgcgcacaccatgctctaacaggagtgtcaacgcaatcgcggcgtcctttgcggcagcctgctgcggttgagcagtggccagaaccgcgcgggcggcgctgaccaacccacgtgggtcggcgtccaatccggccagatcatattcggcgaatcccgcatgtgcccccactgtggtgaaaggcgcctgttgccggttgcgcggatagtattccggcagatacccgaagagaaagtccgaggggctcatgctgtcgttccataccgcgctgatcatgattcgccgtgcacgggtcagcgcgaccaggaaactcttcttctcgcccgacaatacagccgcgaaccgcggatcatgcccggttttgtcgctttcttcaagcgctcccctcagcacgagctcggcaaggtcttcaccaccgaacatggtgttgcgcccggcgaggttcggccacacgtcttgctggaccaccggtatccacgcatattcccagtggcgtccggccgcgcctgccggcgtagtcaatgtcaccgcgtcttccaccggtcctatgtgggccaaggaatcggcctgcacttccatgccccgaacctgtgccatgaatgacgtgatgtctcgactggcggtggaatcatcggcgaactggaacaggcgcattgccgcgtccagccggtcattggccgtacgcccctctgccgtgttgaataatgccgcacgctgccagaccggtgccagaccggtggcgttccacgcaacagacagcgcatagcgcggctgtacgcgctggcttgccggcagccgctccaagccggaagcaacgctgcccaccagatgccacaggttcgcaaaagcgcgggcctgagggtcgttgccgagcaccgcgtggatggatgcgagcgcagcctgcgccggcgcggcggcatcatcaatggcaagcatcacgtacagcgcgtcaacgccaaaggccaagtcatcgccggacggttcaccgagtatttcgacagacactggcaacgaagtcactgacgacgaaaccgctgacgtcgaaaccactgacgaggatgtttcacgacctgtttcacgccgtgtttcatggtatgtttcacgcaatgtttcccatgccgtcgtcagagaggtcagcatggcatcatccgtggcgagatgcgccagcgactccaacgaccccatggccgattcgatcggcgcaagccttgcgggacgcccctgaccgggtttggccccggcactcaccaacgggccgttcatcaacgtggccactctagtccttatatatgccgcgcaggaagccaacgtcatctggcattccgccatcccctcggcacgcaatcgggcaagctccacaagcgcgaacaatccctgcacgaaagtctcgtccttcaaaggacgggtgaccgacgaataccgcaccggtacaccatctcggcgcagtcgttcgccgaacagccgcacggcggcattgtcgtgggtgatgaccgccatgtcgttccaccgaatatgccggtcaagatgcgcccgcttgatgcgccagaccacatcatccagctcctcacgtgaggatcggtacaggccggcggtcaccgtgccgtccgcctgataattcgctgcatcgactccgcccagtatggcggtcagcttgccgggacgctcggccggaggcagcggctcgtcttccggcgagggaatcgacagcgaaatacgagacgcgatcacatcagccatcgtcatgtgcgactgatcagcgacggcactgccgccaaccagctgttcttccttggccttcagccgcccttccacggcacggcgcatcagatattccggatacgatccgcggaaggtctgcaccgattcatccgggttgccgaccagcaccaacttgacgccggcattccccaactcctccaagaagcgcatgccggccagcgtggtgtcttgaacatcatccacaaccagcagccggggcaagcccaacgcctccacacacataggccggtcggaatcatccgcgtgatcggcggcgaatgcctcacgcaccacacgagcgcctgccaccagcaaatacgaggcatccaaacggtattgccccggatataccgcgctttgggctgcaatatattcacggcgcaacgcgaaagccaaacgccattgcaccgacaatcgcgcgtcctccgtcacggcgtccaagagacgtggctcttcgtgaacgcctacaccgagctcatccaatcgggccagcatatcgcgcaactggctgataaacgcatctgaaatacctcgcgtgaacctatccgcgctggtcgagccgcctgccgacgtcggagacggcgaatccgacccttgttgcgagaggcttgattgtgcggaagcggccgagccgggcatctcgccggcaccggcatcgcgtatgagtctcgcccagtcatcctgggcaaagtagacgcgcagcaaatcacaggtgccgcaatcatctcccgctacggcatggcgcagatgcacggccatgacttgacgcagcaaagcatcctgttccgcaccgttcagcaatcgaggcgacggcaatccagttccctcgcgcgaagccgatatggcccggaatgccacggcacccagcgtggtgaccggcctggcctgcacggaaaacccgagctcacgaatcacccgattgcccaatgcgtcggcggccacacggccggatacggccatcaccgcctgcgtgccaccgtagcggcgcagccccgccatcaacaccgataaggcgaattcagttttgccgcttccaggcgtgccgacaatcagcctcgccgctccatcacggtcgatgccgtccagcactgttccaggttcaagtctcgtcatcatggctccagcctaaacccgaccgtcacagagggaaaaattttaccgaacccgacgaagaatcgtacccttgacggtatcctgtagaacgaatgcagggagagcgcattttccaaggagggagggaacagatggacaacattccgatgagaccgccgaagctgcccggatatgatttcgtccagatgttgggaagcggtgccaccgccacggtgtacctatataaccagcgtatgcccgcacgcccggtggcggtaaaggccagcgccaaaacccttgacccacgggccgctgccctgttcaaccgcgaggccaacttcatggccaagctgtcatcccacccgtacattctgccggtatatggtgccggcgtcacctccgatggccatggctacatcgtcatcgaatatgcgccgggcggcacctacaacagcatcatgaaggcccggtccatgacctgcgagcaggtactcgacctcggcatcaagctgtcaagcgcgctgttcaccgcgcatcgcagcaatatcatccatcacgacatcaagcccagcaacattctcatcacctcgcagggcttgcctgttctgggtgatttcggtatctccaccgatgtgtatgaccgcaccgaaaccggattctcgccgccgtgggcaccgcctgaggtgcttcagcatctgaccaatggttcggaagccgccgacatctattcactggcggccaccctgtacgccatgttcgtcggctgctcgccattccagcacgattatcacccgcgttcgcaatcggaactgatttcgctgatcgtcaaccagccattgcctcgcctcaaccgccccgacgtgccggccgatgtggaagcggtgctgcgccgggccctgaacaaggaccccgaccagcggtactactccgcgttggagttcgcacgtgccatgcagcgtgtgcaattcgcatatttcgggcatgccactcccgttaccgtggaagggatgccggcctatcccaaagacatcgagcgtcggcgccgggccacggaccagcgagatcagatcacccgttcgtcacggcgatgggtcaaaccggtgggtattaccgtcggtatacttgcggcgatcaccgcagcggcactgatattcgccttcgtggtcgttccccgcatggacagcgccaccggatcagataccaaacaggtggcgacgcccggcaccaaggatgatgacaacaaccgcaataatcaggatgacgtgatcaccgataccgcgaacgcccagattccttccccggagaatctgaacggcacctatgcggcggatgggtcatccgtgacgttcacctggacgaatccagacccgcaaagcggtgatacctatgcgtgggccatagtgcagggcagcaataccgaccagagcgcgcaaaccgtcacaacgtcagatcccacggtgaccgtcaacgcgcaggaaggctcgcagacctgcattcaggtgtccattgtgcgcaagaaccgccagatgtccgtcagccccgccatcgcctgtgcggccaagccgcaagaatgatccgctcgccactgccgggcatgccaccctggcattgcgtatcgcatcagacgtgcgcccagcagcggcgaattcaccaaatggacaacaggaacggcaggtattggaaccgtaaagcgttgtcattacaccagcaaccagagaaaacaggggtcagggagttcagatggccacatcgtcccagtcatacgatcgtcgccgacgcatcagcgcggctttgcgccgccttatgccctccggagggcatacgtggacggttcccgtaatcacgctcctgctgcttctgggacttgttgccggcgcggtgatcatgagcaccgtcacgcgccgccatgtgcaactggacgatggcaccgtatgggtcacttcgctgaaaaaccagaaggccgcacgattcaacgtaaagaacaaggaggccgacgccggcgtctcctcctccgccccacgattcgacatcgcacagcataatggcgacaccatcctgaccgaaacgaccaaagcctccaccatcaaggcatccacggtcagcaccggtgtcaagaccgacatcaaagccaacaccaccactgtggtcggcggggataccgcagccctgatcaacgagaagaccggcaatgtgtggaccggcttgtcggaaaaccttgattccgtgacccccaccacttccgatccgaaaataaagctgggcgagggcgggcgcatcgcagtaacccacgatggcaaggtctacggataccgtccatccgacggtatggtgctgcgtcttgacaatcccagcagcgccaaggccaaaaccctcgaatcgctgaccgacggcaagcagcagaccgttgaaagctttaccgtcatcgggagcacgccggtaatcgcaaccggcaaaaccgtcatattcaagggcggccgcgtcgatgtcgacacgaccggcaccctcacccttcaggagcctcccaccgatgacatacagtccgattgggtggccgcggcatcaccgagaggccttgcgcttatcccgttgaagtccaatgccaaggcgaatttcatagccaacgggggcaaggcgaatccagcacgaccggtatcgtccaagggctgcgtgtactcggcttggagccagaaggccagcaactacattcgcgcctgctcccccacggataccagcgtcaagccgcaaaccctcgaatccgtcaatactacttccgaattggtgttccgcaccaaccatcgccttgtggtgctcaacgacacggttaacggcaatgtgtggaaccctgaggattccaccaaagtcatcaaaatacagtggaacaaaatacagaccgagcagaccgagaaagaacagcagaacaacgactcggccaacaaccaccacgacttctccaagacctgttccgcacaatccggccaaatcaaagccgaggatgatgaaatcggcgcacgagccggttcggaacagattctcgacgcgctgcgcaatgacgagcagaccgattgttccgtactgaaaatcaccaaggttggcgcaccaaacaacaaagacgtcaccatttcgccgatttacgacggccggtatctgcaactcgatgcctccgccgcatccgcaggcaccgttacctttacttacgatatttccgatggccgcggccagacctcttccgccacggtgaccgtaaccctgaatgatggaggcaaccacgctcccgtacagttcgacactcctcccgagatcgatgtggagcagggagccagttataccgccaatgcgctgagcagcttcaacgatccggatggagacccgctcactctggtctccgctgtggcccagaacaccgaccaggtgcaggtgtccacccgagccgacggccagcttacgttcaacaccggtgcgctggcgtcgggacgtgtgggcgtcgaggtcaccgtctccgacggcacggcaaccggcaccggcatggtgtatttctcggtcaagcccgcgaacaccttggccgcggtcatcgacccggtagcgaaaaccaccgttcccaacacggataccgtcgtcaagctgtcctcttatgtgcatggcacttccttgcagccggcacaactgactcaggtggatacgcccaacggcgcttcgacgaccaccaatgcggcggatatgtcgttgacgttcaaggccaccaatcccggcacctattatgtgccctacatcattactcaaggttcgattccggccaccggattggctcgagtcgaggtgcagcctgccaccggcgaggccgccaaaccggttgccgccaacgatgtcgccctgcttggcgcggataataccgccattgtggagccgctcaccaatgacgtcgatccgatgggcggtgtgctgtccgtcaccacggtgagcgcaccggccgactccggcatcaaggttggtctcgtcagccataagcgcgtgtatatcaccgcgcgtcaggtgcccacgaagcccgtcgcccttacctacaccgtggccaacgcctccggaaccgccaagggcaccatcgtgttgcagccgccggctctggccacctcgaattcagtgcccaaggccagcaatatcaatgcccaggtgcgtaccgacggcatcgtgtccgtggatgtgcttgaccatgtgacctactcggatggcaccacggtcaaactcaagaacaacctgcaatacgacaaggggacgttcaagggtctggccttcgtctctggagacacggtccgctaccaagcatccagcgagaccggcaacttccccatcacctatacggttgaagacaatctgggtaatgtggcttccgccaatatcaccattaccgtgcataagagcgacgcagcgagcaaggccgcgccaaccccgcatgacgccgaagcgcaggttgccgccgggcagaaggtccgcatccccatcacactgaccggcatagacacggatggcgacgacgatcagctgttgggtctgggcaacaaggcacccacgctgggccgcatatccgaagtcggttccgactacttggtctatgaagcgtatccggattcgtccggcaccgacaccttctcctatgccgtggaggattggaccggtcagcgcgcacaggcgcagatccgcgtgggcgtattccaaggatcgtccgactccggcgtatacgccagggatgacgaaatcacgttgaggcccaatacggccgcaaccgtgccggtcgcgcagaacgacatctccggcgacaacaccaatctgaccgtcgacaagcatgtcgaggtccaaggtctcgacggggtgagcgtgaaagacaatatgatctccttcaccacgcccggcagcgccaccaccgactatatcgcctacacggtcaaagacaaggccggcttgtccgatacggccaccctcacggtaaacgtggatccgagtgccgccatcgagccgcctaccgcctacgactatcgtgtgccgtccgccgccaccatcgataagaagtccgtggatgtggatgtttcccagtggatcgccaatccttccggcacagccaatgagctcaaggtcggcgtgcatccctccgccagcgctcacgctcacgtcaagggcggcgagcattcgaccaccatcaccgtcgacctgacgtcacaggcgcgagccgtgccttacacggtgaccaatacgaaatacaacatcacctccaccgcgttcatccaggtaccggcctatggtgtctttccgcccacgctgcgtcccaaggcaccggaattgaaggtcaactcgcgcgagaccattgaaatcaacatcaatgactatgtccgcgtcggcgccggcaaggaaccgtatatcgaaagcgctgattccgtcagcgccaccaaggcttccaactccgatttctacgtgaacgacaagaccctgaagttcactgcggcaaaagactacgcaggccccgcctccattacctttaccgctgtggatggcaagcagggatcggataagaccaagatcatcaattccgcagtgatcactctccagatcacggtgataggccgcgatgtgccgccgcccacgttctcgtcctccactattgatgtcgaggcgggcgcggaccccaagaccgttgatctgacggcgctcacccatgcaccgtccggcgtgtatgacgacgaaaagcaatacacgtattccggtggaagctcatcatccaggcaaatcaccgcaaacctgtcccgttccggtagcttgcaggtttccgccaccaaggatgccgctcctggcaccaccgcgtccattcccgtgcaaatcgcatacggcgcgggcaccgtgaatgccggtgtgaccgtgcgcgtagtgtcttcgacccgtccgctgacacgcgtcggcaacaagacgttgaagatcaaggccggtgccagcgatgccgtgaacgtgcttaccggcgcgtacaatccgttccccgattcctcgctgaccgtcatcagctgcaaggcggatgacgccgccaaactcaccatcgccggatgcgatgcctccggaaacatcaccatcgccgtcgcatccgatgtaggtgcttccacgaacaccgtgctcgtcaccgtgcaagacggcaccaagtccaaggatcgtgaagtcaccgcatcgattaccgtgtccgtgatcgacaagcccgagccgccactgctctcccccgtagccggggaaccgcaggacagcgcggtcagcctcacatggacgcccggtgccgccaatggcagcccgatcaccaactacaaggtcagttggaccggtgccgtcaccggagagaaggattgcggtaccgtcacctcatgccaggtcactggtctgaagaacggcaaaacctattccttcaccgtcgccgcgcgaaatgacgtcggctggtccaagccgtccaccgccgtcgaagccacaccggacaaggtgccgtccgctcccaccgatgttacggtcacaggtggcaataaaaccgccaaggtgacgtggaaagcgccgagcggtgatttcagcgccgtcgacaactattcagtgaccgtcaccggtgcaggtgctccgcagaccaaggaaaccggcaatacggccaccgagctgtcgtttacgttcaacaacaacgacatttccgatggcaccgccattacggcgaccgtcaaagcccataacaaaatcaattggagtgccgagtccgccgcatcgccgtcagagaagatctggggagacccggatgcgccgaacattgcgttgtcgaacgacgacaccacggtaacggcgaaagtcactctcggcaataaccgcaatgccggctgccggcgaatttccttgggaggagacgtcaaggacaccatcgattgcagtgacagtggcgctacgttcgatatcaatgagaacgatttgaacacccgggaaatcaccgtaacggccaccgtggtgccgcagcgcgatgcttcctccggcacgggcaagagcagctttgtcccgcagtacaaggtccagccgcccactgacgtctacaccaccggatccggcagtacatgcaccgtgcattggaccaagcagggacatgcgcagtcctacagcgtgactgccgatggcatcgattccggtacagctactaaccggaactcactcgacttccgaatgagtccttgggccaaatgcaacaccgcatcggtgcaacaggtgttcaacggcgctaccagcgacgccgtcaccggaggcccgcacaatggcgctccttacacctatgagaagaaggctgtaatcaacaaaccgcaggagctgcgctggtcagacaacgctcacgtcattaacgtcaccggcggttcggttgatgtctatggcaagtcggccactgtacaaatcatcatcaatggccaaccgttcacgtggaactccggccagccattggatgtcaccgacttggccgtggccgccgatggcaactacgcgtggagcgtcaaagtcaccggcgggccgggatactccggtctcgacaacactgcggacggaggcagcgtcgcgggcacacgtccctctgactcctcggaggggaccaagtcgctcaaatccggtaccgatgtcaccactttggccaagaacccctggattcttggtttcggcaataccccaatatcgtcaaccaccattcacaagcagtaggagaacatccatgagcgagaacatcgatgacgcgacgcagttgtctgacacgacccgtctgtccgacagcacgcacttgtccgacgccacgcacctggcatccgcaccacacaccggcacgaccccaagcaccgagtcggcgccgcagtccgttgcgctgcctaacctgccgcagcggccgtcacaagcgccgtcagaaaagccgtctcctaccactgatgccgcctccattcctgcgggcgatgacagcaccgtgctcaagccgcgcaagggatcgacgccagccatcccgcagcaggccaccgcgcaatcccagccgcaatcacagccgcagcgtcagtcgagcaaagccgcgcaagcagccgcatcggcactacccgccagcatcaattccggactactgccccagcccacggctcaggtccgggatttccagcagtccttcaatgcgctggtcgaaaatgtctccaaggtggttatcggcaagaccatccctatcaagcaatgcgtcaccgcactgatggtcggtggccatattctgcttgaagacaaccccggcaccggtaagacccagttggcccgaggcttggccaattccatttccaccggtttcaagcgtgttcagttcacgcccgatctgctgccttcggatgtggtgggtgtgactttctacgatcagaagcgcggagaatttgagttccgcgaaggcccgattttcgcctccatcgtgctggccgatgagatcaaccgtgcatcgccgaagacgcagtccgcacttctggaggttatggaagagcagaaagtcaccgttgacggcgtcacacatgatgtgccgcagccgtttatcgtgatcgcaacccagaaccccatcgagcagctcggtacctataagctgcctgaggcgcagatggaccgattccttatcaagacgtcaatcggctacccgggccatgatgtgtccgtcgatatcctcaagcaggtcgatatcaccgaccgtgcgcagaccatttccccggtgctgagcggtgacgatgtcatgcggctgcgtcaggtggccaccgaaatctatgtggatgatgcgattcgtgaatacatcgtcaggctcgtcgaggcgacccgccacaacgagaagatcacggtcggctcctccatgcgtggcgctttggcactgacccgatgcgcccgtatctgggccgcggccgatggccgtgcctacgtggtgccggatgacgtcaaggaccttgcagtggccgtgctcgcacaccgtatcacgctgactccggaagccaccttcgatggcgcgactccggaaagcctgatcgcacaggtgctcgaagacgttccctcccccaccatcggttcctgatagggcccggaaaggtatccgaccatggcatctacatccgccgcattacgccgtcgccggcgcgctgaacgcatgttcaagcgcgcggtaagacgcatcagacggttcttcgcatcctacgtctcgcccttgggctgggcggtaacgggcgcaggcatcgcatgccttattgcgttcccgtttctgggctggtatgagctgctcgtattcggcatcgtggcgatggtgatgatgctcgcggcaatcgtgctttccctcggcaacacacgcttccacgcgtccatcgtcgtatccaatcatcgcgtgaccgtgggagacaccgtatccgttatcgtcggcatcgacaacaccggcagaacgccgacgaccacggcacgcggatatctgccaatcggcgatgcgcatgaacgattcaacatccccatgctggctcccgggcaatccaagcaaaccgatgtggagttccgtaccgtatcgcgcgcaatactgcccatcggcccattgcgcatccgcaagggagacccgttcggtctggtgcgtcacgaaaaggagctggccgaccgcatcaccgtattcatccaccctcgtaccgtgcgtctcgatactctgaatgccggcgtgccccgcgacctggaaggccaaccatccggccagatcgtggatgatgatctcgacttctacggattgcgcgaatacgagccgggcgacgacgtgcgtaacgtccactggctgagctccgcgaaaaccggcacgttgatgattcgccaatatgaggccacgcgccgcaccgacacctcggtgaccatcagcgtgaacccggacgaatacgtcaacggcgaggaattcgagatggcggtgtccatccactcctccatcggcgtcaaatgcctgctgcaggatcgtccattgttctgccacgcgggcaacgcgcacggccagccgcgcaacgccatggagttcctcgacaacgccagtgccatagagcctgatcgtgaggataatccgaatctcgccgagggcacgctgaagcacagtcctgatgcttcgttctattttttcactgttggatcgctgaaagacatcgagcaaatcaagcgcatgaccttggccttgccccgatcggccagctgcgtggtattgcaggccagcgccggcgccaatcgcggcatcagaagattcgccaacttcacattggccaccatcggcgacctcgatgatctcccgctgatcatgggggtgctcgcatgaccttcgaccagtccagtatcaccaataccaataccgctgcgtacgccggatcgagcggcacatacaccggcacttcctccggcacgtacaccgggacctccaccaccaccggctcctgggccgactccacacattcggttatctggatgaccagaggcaatgtgcttcgcggcatgggcctcagtcgccagccgtggggcaaacgaatcgccagcctcgtactcatagcggcgatgatgttgctggcgcaagccaatctcatcgacgtgtacggcggcgtggccacttgggcgattgccgctgtaccggccaccttgctgggcgcgatcatcgctctggcgggcatgttgccggcgttgcgactgtggtggcaaatcgtgtttctggcgtttgcccaattcatcatcggcccggtggtaacgctgagttccactacgtcccattacgtgattcccaccttgaagaccttgagttcaggttgggaaatgacgtttggctcgttcaagtacattatttccgtcgatccgcctctgggcacgcaagacggcgtgctgatggcggtatggaccatcggcctgtggcttacgttcttcaccggcgtgtttgccattaatgccaacgcatggttgtctctggtgggagtgctgccccttgcggcggccgtggccgtatgtgccctgctgggcacagacagcggctggcaacgcgccatctgcggtattgcctttgccttgctgctgattatctggctgtcttggcgtcttgaactgctggaaggggggcgctggatatccgcgctgatcatcgtcgtgctcgctgccggccttgctttcgggggcacgttgctggtgccacaggaccgtttcgtgctgcgtgaccgctacgatccgccgttaagcccctacgattacaccagcccgctcagcggcatgcgatcctatatcaaggaccacaaaaaagacgtgttgctgaccgttcataatctgccggccggaacaccggtcaaacttgcggtgatggatcgattcgatggcacagtatggaacctgtccgattcttccgaagccacggactcctcgaattatcatcgcgtgggcaccacgatcaaggcggatgagcagggtaaatccttcactgcgaccttcaccgtcgatcaggaactgaccgacacctggctgccgctggcgggagcggccactggcgtgagcttcgccaacgatgccgacaacggcaatgacacgttttactacaacacggataccgattccgccattattcccgccggcacgcgtaaaggcctcacctataccgaatccggcattatcgcccgcaagcccaccgataagcagatcagcagtgcggctgcggcccgcatcacccaaccagaagcccaggatgttcccgattcggccagcaaactggccacgtccattgccggcgggcagtcctcgggcggtgccgcagccacggcgttggctgacacattgaaagactccggatggttctctcatggacttgaaggcgaccatccctccgatgccggccatggcaactaccgcatcaacaagctgctggcaggcacggccatggtgggcgactccgagcaatatgcctccgccatggcactgatggctcgtgatctgggactgccctcccgtgtggtcctgggcttcctgccgaaaaacgaggatggcgaaatcaccgatgcccgcacggagaagacctcgggcaatggcaccaaaatcgaattcaccggcaacgatgtcaccgcttgggtggaaatcaaattgcagggcctgggatgggtggcgttctatccgacgcccaaggagaccaagatgcctgatgaaaaccagaacctgacgccgccgaatccgcagacgctggtccggcaaccaccagtgccgttgaccgatccgctgcgcgatcagacgcaagccaagggccaaagctcattggccggcgccgacgccgatgattcgccgaccaacctgttctgggcgcggttctggcgagtgacccgcaaggtggccctgtacggcagcccattgtggaccctactcatcgcctgcggtctgattctgatgttcaaggccatactgctggcacgagcgcggcggcatggcagtccgaaagcccgtgtggcagcaggttggaatgccatacgcatgcttgccgagcaaagcggcatcacagccaagggcactcgtcgagatcaggccggtgccatcgcccgtcaactcggcacagatgaccaggctttgatccagcttggccgggaagccgactacgccacgttctcggggcaagacattgaatcgggccaagccaccacatattggacaggagtcgaccaattgcgcaaggcaatgctcgcttctttgccgcgtttcaggaggatacgtacacgactttccctgaaaagcgtggctatactgtcaaatgggcacgcagcaaagccgcacacgacgcatgtcaagcgcacgcgtaagaaggggaaggcgtcatgaccacaggctccatccgtatcgcgatgaccagtgacgtgggtcttaggcgcaaaaacaaccaagacaccggattcgcgcaacaaggcgtgttcatggtctgtgacggcatgggcggcggcatgggcggcgagcaggcaagccagttggctgcccagcatttcgcacaattggccgccatgccttcacgcacccgtcaggatatcgacgacaccttggcacgggcccagcacgacattcttgatctgggagaccgccttggcggcgtggccggcacgacctgctccggtttggtactgccccaagatcatgcggattccaccagcgcccgcagcgctgctttgttcagtgacgccgatgatcaggacttctcggaccagacctatgtggtcaatgttggcgattcccgcacctaccatctcagtccgttggcgcatgccgatgctcccgccacggatatcattcccgtgtgggacgccgcttcgctgatccgcatcacgcgagaccattcgcaacgtcaggaagccatcgattccgggcagatgttgccggaagaggcggaggcgaccattccacgcaacatcatcacacaatgtctgggtgatccggatggcatcatgcccgacgtatatgtcgccgatctgaccggccgcttcatcatctgttcggatggattgcatggcgaggtgccggacgaacagatcgcggccatcgccgcggcgcattccagtccgcaggaggccgtggacgccttggtggcggccgctcttgatgcgggcggaaccgacaatatcactgtgattgtggccgatatgccattgaccgaacccgaacatcatgcgttcagcgcattcaggctggacgaaggtgaggatatcggcgccattgaagacgcaacactacaaacactacggaccatacgttcggcataaccgagcgaacataaggaggtaatcccatggttgattatgatgctgcggtcgctgccgttcaggatccgaacgcggatccgattctgctggcaaaaatcgcctacgagaatccggaattcggtgccaatgtcgccgtgaatccgcgctgttatcccggcttgaagcgttggatcgccgagttcggtgacgatcgcgcccgcgagaccctggcgcaatacgggttcactgccgaggcattcggcggcccggttcaggatcagaaagccacggcacaggcggcccagcagcccgccgccgaacaggctcagcagcctgcggctcaggcggcattcgaggagcctgtggccaccaatccttacggtttcaccgccgaacaggccctgaccaccaccgaccagatgcaaatcgcccagattgcccagtacgcgcctgaactacgcgcctgcatcgcacgtaatcccaacacctatccggcactgatcgaatggctgggccagctcggcgacccggcaatcaacgccgctctggcttcccgtcagtgaaaggacggcatcatcatggccaaacttccctaccctccagcacctgaactgggttggtattctgacgatccggtggaaggcaccccggattccgcagttggcacagccgaaccgcagaacgactacgggcagcccagtaccgcggaagcggcaaccaataccgcttttaccgcagagcctgccgccacggccgccgccgctgagcccgctgccaccgctccggcagacaccacaccgcacgccgccgaaaacgacatcgaggattgggacagcaccgtgctctcctcctcgttcacgtccaaggcaccaaagaagacgtacctgctgcataacgatgtcaccggccagaccatcgtgatcgataagagcacgttgctgggccgcaagccttccatggatgtgccgcagggtgccaaggcggtgcgtatcgtagacccgacccgcaccacatcccgcaaccatgccgccatcagcatcgacaccgatggcgcgctgtggatcgaggactacggctcgttgaacggcacctacatcatcaccaatggccaagagacacaagtcaccaagggcacaccgctcaagctcagcgcgcctgccacggtgcgtatcggagaccagttcttccagttcaccgaaaaacaggcttgagtaatcaagcaacgagcggctgcctgctcttgttcaacaggaaaatcacaatggcaaatatacggatggcccggaactgatatagttccgggccatcttattgcgattaacgcaagatctgagtcctagaaggggcatcctttctaggaccttctcacttactcctcgatgtcaggctgaccgccctgatcggagtagaaatcatccgggttgaagtcgtcgccgagcttcagatcgccgaactcgaggttcgagaagttcaggtcagacaggtcggcgtcggagaagctcgcgtcgccgagatcgccatcgccgcccagaccgaagttcgggtagatggtgtcgcggatggccttgtcaggctcgaccacggcgttgcggtagcgcgcgaggcccgtaccggccgggatgagcttaccgatgatgacgttctccttgaggcccttgaggtcgtcgaccttctcggagagggcggcttcggtgagcacgcgggtggtctcctggaaggatgcggcggacagccaggagtcggtggccagcgacgccttggtgatacccataagcgccggacgaccgacggccggacggccaccgttcttgacgatgttgcggttgatctcacggaagcgggcgttgtccaccagctcacccggcagcaggtcggtgtcgccggagtcgatgatggtcacgcgacgggtcatctggtgcacgatgacctcgatgtgcttgtcgtggatatccacaccctgggagcggtacacggtgtgcacttcctccacgatgttgacctgggcggcgcgcttgccgaggatggtgaggatcttcttggggtccacagaaccttcgaccagctgggtgccgaccttgatgtggtcgccgtcggcaaccttgagcggcacgcgcttggagacctggtaggtgatcggcttgatcacgccgtcttccttcggtgcgccggaatcggcgtccggggtcaggatgatctggcgaccgcgatcgttctccacgatcttgatgctgccggcgaactcggtgatcggggcctcacccttcggggtgcgggcctcgaaaagctcggtgacacggggaagaccctgggtgatatcggaggccgcggccacaccaccggagtggaaggaacgcagcgtcagctgggtaccaggctcaccgatggactgggcggcgacgataccgacggtctcgccgacatcgaccagcttgttggtggccagggaccagccgtagcacttggcgcacacgccgcgcttggactcgcaggtcagcacggaacggcacttgacttcctcgacgccgtgggccacgaggtcgttgagcacgtccatggacagggcgtcgtcgcgcttgtacagcacggtctgtccgtcggccgggtcgatgacgtcggcggcgagcagacgggagtacgggccaccgtcggcggccttgacgagcaccaggttgccgtcgttgtcgcgctcggcgacgcggatgggcagaccggccttggtgccgcagtcctcttcgcgcacgatgacgtcctgggagacgtcgaccagacgacgggtcaggtaaccggattctgcggtacgcagtgcggtatcggccagacccttacgtgcaccgtgctgggagatgaagtactccagcacggacaggccgtcgcggtagttggacttcacaggacgaggaatgatctcacccttcgggttagccacgaggcctcgcatacctgcaatctggttgatctgcatcatgttgcctcgtgcaccagactgcacgatgatggccaggttggaggtcgggtcgaacttctcctcgacttccttggacacttcggcggtgcactcggtccacaggtcgatgagttcctgacggcgagcttcctcggtcaacagacccatctcgtagttggcgttgaccttgtcggccttggcctcgtactcggcgatcttctcgtcgcgctcgggcggctcgttcacgtcggagaacgcgaaggacacgccggaccacggtgcgcgggtgaagccgagatccttcagggcatccagcgtggcggccacctgctgggtggagtaacgcatggcgatgtcatcgacgatcttggacagacggcccttggccacctgctcgttgacgaacgggtagtcggtcggcagggtctcgttgaacaggatgcggccgtaggaggtggcgaacagcacggtgccgtcgtggaagcgttcttccttgacgacctcgtcctcgccttcgcgcgggtcgagcaccttgacttcgccgggctcccagttcttcggcagcacgaagctctcgggcaggcggatgagcaccttggcctgcatgtcgatctcgtggcggtcgagggccatttcggcctcttccagcgaggagaacacgcggccctggcccttgacgccttccagcacggtggacaggtagtacaaaccgaggatcatatcctggctcggcatggtcacggtgtggccgtcggccggcttcaggatgttgtcggaagccatcatcagcgagcgggcctcggcctgggcttcggcggagagcggcaggtggactgccatctggtcaccatcgaagtcggcgttgaaggcggcgcaggccagcggcggcaggtggatggccttgccttccaccaggatcggctcgaatgcctgaatacccagacggtgcagcgtaggtgcacggttgagcagcacggggtgctcggagatgacctcctcgagcacgccccatacttcggcgtcgccgcggtccacaagacgcttggcggacttcatgttctgcgcatagttcaggtccacgaggcgcttgatgacgaacggcttgaacagctcgagggccatcggcttcggcagaccgcactggtgcatgcgcagggacgggccgaccacgatcacggaacggccggagtagtcgactcgcttaccgagcaggttctgacggaaacgaccctgcttacccttgagcatgtcggacagagacttcagcggacggttggaggcaccggtgaccgggcgaccacgacgtccgttgtcgaacagggagtcgacggcttcctggagcatgcgcttctcgttgttgagcatgatttcaggggcgccgagctcgatcagtcgcttcagacggttgttacggttgatcacacggcggtacaggtcgttgaggtcggaggtggcgaagcggccaccgtcgagctggaccatcgggcgcaggtccggcgggatgaccgggatcacgtcgagcaccatggcctccggcttgttgccggtggtcaggaaggcgttgacgaccttgaggcgcttcagggccttggtcttacgctgttcggaagcgtccttgatctcctcacgcagttccttggagatggtctccaggtcgagggactgcaggcgcttcttgatggcttcggcgcccatgcagccgtcgaagtaatcgccgtagcggtcctgcatctcgcgccacaggtccacgtcgtcgaccatgtcgccgggcttgagcttcttgaacttgtcgaagacggcgtccacacgggcgatctggtcgttgtagcgggtgcggatggcggccatatcgcgctcggcaccgttacgcagcttggtgcgggccgggcccttggcctcgccggcctcctcaagggcggcgagatcctcttcgaccttcttagcgcgggcttcgatgtcggagtcacggcgctgctcaaggcgcttgatctcggaatcgaactcgtcctgcaggccgggcagatcgttgtgacgctcgtcttcgttcacctcggtgaccatgtaggaggcgaagtaaatcacgcgctccaggtccttcggggtgacgttcagcaggtagccgaggcgggaaggcacacccttgaagaaccagatgtgcgtcaccggggcggcgagctcgatgtggcccatgcgctcacggcgcacgcggctgcgggtcacttcgacgccgcatcgctcgcagacgatgcccttgaagcgcacgcgcttgtacttgccgcaggcgcactcccagtcacgggtcgggccgaagatctgttcgccgaacagaccgtccttctcaggcttcagcgtacggtagttgatggtttcaggcttcttgacctcaccgtggctccaaccacggatgtcatcggcggtggcaaggccgatgcgaatcttgtcaaatgcgttgacgtccagcacttgttaatccgtttctgttcttgagaccttcccaagctccccttgtcaggggagctgtcagccaaggttgactgaggggtagtgcaaaccggaaaggtctctgtacgttatttatttcacgttggcggggctacacgcggcgtattgaccgcatgcagcccgagggatcactggtattcgggctcttcggccttctggtcttccttggcggccgcgtcggggcgggcgccgatgttgaagccgaggtcgtcagcggagctggccggatcgtcatcctcatccttcatgtcgatggccacgccttcggcgttgagcacttcgacgttcagggacagggactgcatttccttcaggagcaccttgaacgactcggggatgcctgccggcggcaggttatcgcccttgacgatggcaccgtagacgcgcacgcggccgtcgacgtcatcggacttggtggtcatcatctcgtgcagcgtgtaggcggcgccgtaggcctcaagggcccacacctccatctcgccgaagcgctggccaccgaactgggccttaccaccgagcggctgctgggtgatcatggagtacgggccggtggaacgagcgtgaatcttgtcgtcgaccaggtggtgcagcttcagcatgtacatgtagccaacggaaatcggcttggtgtacggctcaccggtacggccatcgaacagggtggccttgccgtcggggccgaccagacggtcgccgtcgcggttcggcagcgtggtggacagcaggcccttcaggacctcaggcttgacaccgtcgaacaccggggtggcgaccggggtgttcggctcggccttctcggcaccggacggaatcagcttcttccactcggcttccagattcggatccaaagagatgtcccaaccggagtgagcaatccagccgaggtgcagttcgagcacctggccgaggttcattcgggaaggcacacccagcgggttcagcatgatgtcgaccggagtaccgtcagccaggaacggcatgtcctcttccggcaggatgcgggagatgcagcccttgttgccgtggcggccggagagcttgtcgcccaccgtgatcttacggtgctgggcgatgtagacgcggatcatctggttgacgccgttgggcagctcgtcgccgtcctcctcggcatcctcacgggtgatctccttgacaccgatgacggtaccggtctcgccgtggggcacgcgcagggaggtgtcacgcacctcgcgggacttctcgccgaagatggcgcgcagcaggcgctcctccggggtcagctcggtctcgcccttcggggtgaccttaccgaccaggatgtcgccggcctcgacctcggcgccaatgcggatgatgccgcgctcgtcgaggttggccacggcgtcctcgccgacgttcggcaggtcgcgggtgatctcttcggcgcccagcttggtttcgcgggcgtcgatctcgtactcctcgatgtggatggaggagagggtgtcgtcctgcacgaggcgctgggagatgatcacagcatcctcgtagttgtagccgttccacggcatgaaggcgatgagcaggttcttgcccagggccaggtcgccgttctggatggcggggccgtcagccataaccgagccggcttccacacgctcgccgtcgtggacgatcgggcgctggttgtagcaggtggtctggttggagcgctggaacttggccagcttgtaggagctggtggtgccgtcgtcgttcatcacgcggatcaggtcggcggacacgtaggtaaccacaccgtccttctcggacttgatgacgtcgccggagtcgttggcggcgcgccattcggagccggtgcccaccagcgggcgctcggattcgatcagcggcacggcctgacgctgcatgttggtacccatcagtgcacggtggccctcatcatgctccaggaacggaatcagggaggcgccgagggagaccatctggcgcggggagacgtccatgtagtccacggagctcaccggcacatcgaccgcctcttcttcgccgactcgggcaagggcggacttctgcacgaagttgccgttctcgtcgagctcctggttggcctgggcaatgacgtggtcaagatcgcggtcagcggtcatgtactcgacctcgtcggtcacgtggccgttgacgaccttgcggtacggggtctcgatgaagccgaacgggttgacgcggccgaaggttgccagggagccgatcagaccgatgttcgggccttcaggagactcgatcgggcacatacggccgaagtgggacgggtgcacgtcgcgcacctccatggaggcgcggtcacgggacagaccgccggggcccagtgcggaaagacgacgcttgttcgtcacaccggacagcgggttgttctgatccataaactgggagagctgggaagtgccgaagaactccttgatggtggcgttcaccgggcggatgttgatcagggactgcggggtgatggcctcggcgtcctgagtggtcatacgctcgcgcaccacgcgctccatacggctcagaccggtacgcagctggttctgaatcagctcgccgacctggcggatacgacggttgccgaagtgatcgatatcatcgacgtccacgcgcaggtcaacgtcttcgccgttgcgcttgcccgggaaggtcgccgcaccgtcgtgcagggccaccaggtacttgatcgtggcgatgatgtcttcctggtggagggaacgatcgttgaaatcggcctcgacacccagcttgcggttgatcttgtagcggccaacgcgggccagatcgtagcgcttggtgttgaagtagaaggagtccagcaggttcttgccggcctcgggggtcggggtgtcggccggacgaatcttgcggtagaggtcaacgagggcctcgtcctgggtctcgagggtttccttctccagtgcgtcgagcaccagcgggtagtccttgaatgcctgggcgatctcggacttggtcatgccgatggccataaggaacacgatggcggactgcttgcgcttgcggtccacgcgcacctgcggctggtccttcttgtcgatttcgaactcgagccatgcaccacggctcgggatgatcttcgcgccgaagacttccttatcggaggtgcgatcctgctggcggtcgaagtagacgcccggggaacgcacgagctgggagacgatgactcgctcggtgccgccgatgatgaaggtaccgtgcggggtctgcagcgggaagtcgcccatgaacacggtctgggacttgatctcgccggtgtcgccgttctcgaattcggcgttcacgtacagcggagcggagtaggtgtaatccttctccttgcactcctgcacggtgtggcgcggctcctcgaagtacgggtccgagaaggtcagggacatggtctgtgcaaagttctcgatcggggaaatctcgttgaagacctcgtcgagaccggaggtgtgggccacggtgttggtgccgttagcctcatcctcttcgacgcgcttcttccagcggtcggagccgatcagccaatcgaagctgtcggtctgcacgcccagcaggtagggcacatcgatgggttccttgatggaaccgaagttcacgcgatccgacgccttgtgcaggtcaatgtcatgctggtcggcgcgtgcgatgatggtggtggtgttcgtcgtagactcagtagccaatggacgttccttatcgctcgctaatatgtggtaattcccctgggagcaccggcatggccaccatatgcctatgcggacgcttcattgtcgacggcatgcccgcaatatgacacacctcatgcaaattcaaaagaatactgatatgcgaggacatctttagctcctgctgacgaggaagctgtcgagcggagcgagactgagggagagacccagcgtccaaacgccaaccgcagatcctaccccaccgtaaacgtcaccggatcgctcttcaccttcggatgatccttcaaactcagctgcgccacgtacgttcccgcattgactttggcccaacctgactcatccgtgcatttggcgagcgtggcgttcgcattggtattccacgtgaccttctgaacgtccttatcgcccttagccatcagcagcagacgtgaatccgccgggcacacatcggacttgtaaatcgtttcctgaccggaagtaatggtgagcacacggccggaatcggacccgtccactaaacagttgcctgacccctcgtgcacgatggtcgcggtgaaatcaagcgatcctcctaccggcacggattgggaggccgcggaaagctgcaatgtcacatcactggccgagcaatccttgacgttgctgactttcttcggcgccggcgtggcgtcgcgggaaatcgcatacacctcgtcatggtggatcatcgagttcacggcaccgataccccggccaaggctatacacgcagaatacaatcagcgcgattatcagcagcagcaccgtaccggccacgatacgccgacgacgatagatggcctgctgctttttgctgatcctgcgcttgcgcggcttgccggaacggttgttttgggagggcccgccggatggcccattggccccggtgccggctccgcgtgccgttctcgcgcctgatgtgttcctctgcactgccataactcttccagtctacggtcaccacgcccatacacgcttggggagcccaccatttttcacaatgtcagctgggtagtcgcaggccgccgtccagaatctctatcaggccgtcatcgtcaaggctggcgatgcaggcggcaagctgaatctggtccttccaaagcttgtcggcatcttccctgggcaacgtggctccagcgggaagctcgcgcagcgcggcgagcaccagaccgcgcacctgtcgatccgtgccttggaatcgttggcgtgggcgggtgcggcgctcccccagtccggggcggccggccttgagaaatgcacagtcgtccgcaatcgggcaggtgtcgcacagcggcgacttggccgtgcagatcaccgcgcccagttccatcaccgactggttccacgtgaccgatgggcgctcgccacgatgcagtcgagagcgtttgccgccacggatagtgctgttcacgacatgttcggcgctaccggcattatcggcgacgtcagcatcgcacccgagaatctcgtctttgggcagcatgcggttcgccagcgcgcgttcggccgggctggtcgctcccccgcgcgattcgacgcccaggaacacgcggctcagcacgcggcgaatgttggtatcgatcacggcaattcgttcgccgaacgcaaagctcatcaccgcggaggcggtgtaatcgccgatgccgggcaatgcagtgagttcgtcatacgtgcgcggcagtttgtcggcgtaatcttcagccaccacgcgggcgcattcctgtaaccgcaatgcgcggcgtggatagccgagccgcccccatgcggtgatcacctcggccttgggggcctcggcgagggcgcgggcgtcgggccaacgtgccatccagtcggtccagtacggcaccacacgactcatctgcgtctgctggctcatgacttcggataccagcacgccccacggcgtggcccggccgaagcgccatggcaaatcgcgcgcattggcctcccaccatgcgcccaatcgcaaagaaattgctgtgtcgttcatcgttcttattcttagcagctatgacgaacgaagcagaacagaattcgcagaacgcacagaatcccgaaacaaaagtcgagaagatgttcgagtacgggtaccgtaaatcgaattacggaccggacgaactcgtaaccgacgcgcatggcaaccccatctccgtggtggacgcgatgctctcggctgaaaaggccgccaccaccgaaaccgtaacaccgcatctgtgctactactcaccgcgcattcccggcaacaccggctcggccatccgcctgtgcgcggtgaccggcaccatcctgcatttggtggagccgttgggtttcaacctgcgcgacaccaagctgcgccgagcaggcctcgactaccacgacatggcccacgtggtgctgcacccgaatttcgacaacctggtggagtccatgcccaattcgcgcatcatcgcgttcaccgcacatgctaccaagctgtacaccgaggtggaatacaagccgaccgacatcctgctgttcggccccgagcccggcgacatccccgacccgatggacatcatggagggccctcatgtggccgaacaagtgcgactgcccatgcgcccgtccttgcgttccctgaacctcaccaattgcgcgtccatcgccatctacgaagcctggcgccagctgggattcaagggcggagcgtgaacgaggaaacgtcaagcctcgcgaaagtgaaaccctaattgcagggcggtcactgaggagcattagcttagacttgtatcagtgaggccggtgacatgcgaatgcgcatgtcaccggcctcactgattaaacgctaacgcccggaatccgtatacgtcacttgcgcggcgagattgttggtgggtgtctgatccagctgaagttgcgcagcgtggggtgccgttttcacatcgtattcgacggtgaacgtcgcaccgggagacaacagacatgcgatattcgcataatacgtggtactgccggctttgatcttcataaagtcactctgcagcgcgggaatctggtccttggaatcactggtgacggtgatattggacacgctgccacctaccggtttggcaatggcaatcgaatgccccacaacgccaggcttgctcaggctctccatcgccgcatgaatcgccgctttctcctcgtctgacgctcccgactgcttcaccaagtcactcatcatgcccaacgggaatgttccggtaatataggcgggaagtttcgtggattgatcagccgtcatggtgttggtcgtggtgtaggtaacgtgatatgtggaagagccgtctttgttatcggcagtcttgctcaccgtggcagacttcttcatgtaccagtcagttttggtccagcccatttcgttgacgtatacgccggtgaccggattctgcgcatcggtgcccggctcgccaaccacgcctgctttcttcaggactttctgatcggacttatcgaaggaccacatgtatacgtgtcggttctcagtgagctttggcatagtagcaacaagcgatagcgccttatgcgcgttcagcccggaaagcatgccattgatgatccgctgagcgctttcctcaaagaatgcgtcctgagcattctgatcagtgatatcgatgtacacctgattcgacagatactgagcagtgttctgtgcagtaagcgtcacttttcccgaactcaacgtgataggcccggtcacaccgagcaaagactgtagcgcgactgtatcgaacgacagtacgccgtcgatattgttcgagccaaacgactgcctcgcccacacttctttggcatactgagccgcggccgggaagttcggcgtcgcggaggccaagcgaatgtcaccaccataggaaaccccaagccgtgagatggcatagagcttgtccacttcatccgtgctggtcaccggagccgtcaggtcgaacttggagtcggaatagaactgtcccatggaaatagtgccgttattgactgtcagcgtaccgacggatcccaccacgccgccagcagcctgcgtttccgcattggtttgcgagagaatcagataattgcgggtaccctcatgaccgaacaatgccgccaaactgtcaagtgtgctggcaacaccattgatctgggatgcagcgctatccaatgtggctttgccgctggtcaatgcgtcacgaacctgggcgatatgcggttcaggagcttcattcagcgcagtgacctgacgctgtagagtatcgttgcttttgctgattttcgacgatacttcagtcaacgttttgacattcagattgccatccgcattggcaagacccgctttctgcatggtatttgccgcatcggtaaggcttggcaaaacgtcggaagcaagagtgtccaacgcatcagtggcgatacgggtggccgcaaaatcgttacctatcaccggcaacatcgaagcactacgccacacccatccatcagcctgtccccgggcgccgtcgtacgctgctgcaattgaggagctaccgcttcgatcgcggtcatacctgccatgctcgagtcttggccggaaccggccaaagcagcaccaatgccagaatcacgcaccacacccactgattgagtgacttcgtctttaatcaccatagccgaatgcaccagcgccgcggcataagcgcagaatgccgccaataccaccaccaccgctataacgatgttccggccggtgtgcttggtctgggtctcgttctctttaccagccttatgacgcattcttaccccccgttatacgattcctcatatcgccagcagagtctacacccaataaaaaagcggttgggttcatgcacgcaacatgaatccaaccgctctgtgacccgcaggttaacaatcactgcgcggaagtggagccaccgtcgctagtcccgccggattggtccggattagtaggtgtcgttggctgatcaggatccgtgggattcgtaggattcgtcggctgatccggcttggtcggagtcgtgggtgtagtgggagtatccggagtcgtgggcgtcgtgggagtatccggagtcgtaggcgtagtgctggttccctgatcgacctgctccccatcggtggttacccccccgttgctggtaccgctattggaggaataaccattgttgccgccggagttctgagagctgctcgatttacgctgctgcgccgcagtgtagtcgtccatggacgatttcactgccttggtagcatcctgcaagtttgtaaacgatttttcgagatcagctgccttcgggttggactgtttgagcaatgcattcgcatcgtcaagcgccttttgcagggagtcgcgcgtgctttcgtctgaaacggcaccatcactgtcagccaacgtctgctgggcatcagaaacagcagattgcagcttttgcttggcggtatcgatcttcttctgttcctggctcttcgttacggctttggcggcagttgtcacagctttggcactgctctcgagcttagccgtcaatgcgcgattgcttttggcggatttgctcagggaagccgtgggcgcgatatagttgcagcttgcggctttgccaatcgaattcgcctctgtcactgcgcttttcagtgtgcttaccgtagcagcatcagccacctgaccgtcggtaatggcctgcacgcttttgctgttttccagcgctttcgagagtttctccgacgccttggtgtaattatcgctggaggagagacactgcgacatcgcggtggagtgcgcatcatctttcttcagcgaattccaatacaccaatccgccgatgacaagaccgataataatgaccacagtagccacgatggtcacaataagccacgggtttatcttgcgttccgggatgactggttgtgccaccatgtcggccgcgaagtcatcagcgcctgcattgtcagaagccgactcagtagtggattcgtcggtttgatcagggccagaaaacaccggtaattcaccgaacggagtggttgtatcactgccatcctgcggcggcagggtcgaagtttcctcgtcgccatccagacgggggaattcgattggcttgatatcccagaacgtgtcgacgatatcgcccgcctgcgttaaagatgacgtgggcgtgtcacgcttttcgtcgctcattactgaacgtctccttcttccattcccatgcaaatgacttcctcacaagctgcaacagctgctccggtacacattcttatggaggcagtcgtcactcaccgctcgtgggagtgatcccacctgtaacattcacattgaaattaggcacatccggcataaccacggtgagaggtggtgcaggtttaggcggcgtaggcggagagagaggagccggtgatggctgggctgttacgggttgctccgacataaccgatactggcgacggctgcgatacggcctgtgccacggaccgcgtcacgggctgggcctgcgccggtgccatttgcgctggaaccgtctttaccggtgccacatgtaccggcttcatcacttcggtctccgcagcattggactggtaaggcgcaaacaccggcaacgaaatctccacaggttccgcagaagcgggttccgcagcaaccggctgtgtttccttcgcatgctcgatcatggttcgagccggcgcaccattcactcggtaatgcttgcgcatgctgttgagtatgatccatattgccttattggtctgattcgcggctttacggaatacagggaaatctttggtgaaggggtcctccacatcgcgaggggccggaatcatggggcgaatgaacgaggacgcttcgatgaccgaattcaatcgctcctgcacagtcaagcccttgaccaagtcatgctgtgcgcaatacagacacatgttggcaaaatcagtgacgaggaacgtgcgccgaacgaccgcaggagccatatctacgatattattgcgctgctcttcttcgaaacagagaatcaaatcagcgttttccgccaactctcgcgtgagctgacgggaccggaattcacccgaatcaatgcccacgctgtccatcagacggccactcgaaggatcgatgggatgaccgaccaaagcatgcgtgccagcactcgaaacagtaatggaggtaccagagaggtatcgccgcatcaacaactcgcccatgggcgaccggcagacgttgcccgtgcagacaaacatgatatgcatggaccgtgttccttccttgatgaccctcgaaccgccgtgcagtgttgattactgctgttgctgcaaagccgactggttgaccttatcaaccgctgcctgcaattgctgcgaagcactctgatatatagctgcgctcataatctggtccgacagcaacagctgctgtgtcatgttcaaagcgtcggaatattgcttacgcgtttgcaaatcggcactagataccgccgaactagtggaaacgctctgcagctgctccagctgatcgccgagcgcctgtttcgcattcagagcatccttgcgcgccttggatgaagcaaccgcatcattcgcatcaagaattgcctcgttcttcgaaccaagtgcacgagtctgctcggtgatggctgcatcggccgctagattctgatcggcttcagcatcaggactgcaactattctccgcctgcttgacatcaccgaccttatcaatcgccgccttcagattatcgatggtctgtgggtctgcaacggcatcggccgcagtctgagtggccgaggtggttgactccacggtcttcttgagtcgtgtgacgctcttttgattgatggttatggcttgctggcaggcgtcgaaggccatctggctggagtcacgacgttgcaatacggtgaacccgctaccggccgcagccaaggctatgaccaataccacggcaatgataatggccgattttttcgcgttccataccttcgccaccgcagaagtgcggggagcaagcgaagaagggtcaagggcagggatggaaccttgctcgggcaccgtggaggggaaaagatacactcggtcccccatgcccgaatgccggccgacgtttccgccgttgagatcgtcaatcggccaattgtattttctgctcgccatgcgcgatgcctctctcttacctctcagcacttgtacagcgcccctgtacgcggcacctttcactctgttcgtaacatacatgttttaccaaaaccgctcaaccattagcttacgatgcgctcaattgttcaccagaatctctcttttgcccatatatccgcgtaccaacaacccatatgaacatccacagcgcatagaaggcatagccctcgaactggatatacagatatgccaacaagaccatccaacacaccgtcatcttgttccatgccccgttacgggtgatgtgcatgaacaacaacactacgccggccaaacacattagtatgccaaattcggtaatcgcatctacataagcgctcatcgtgaaaatgtaatggtctccgggaggattgcccagcaaacggatttcctcatttgactgtggtttgcctcccatggccgtaagtgcctgcactgcggccccatatccacgagcaatggcatctttgaggttgcctataccgaatccaaaaaggaaatgcgcccagtcggctttccacgcttcagctggggccagcgtacggaacagccgtgccaaggcggagaaatctccgtttaccggaccgttggcgagcaacgattcgacgcgcggattacgcagcatcaccactgacccgccgattccgattacgccaagaccggcaatggtgatgatgatatcgcgcagacgatgaaaattctcggcaacgatcaaccacaacagcagtgcgacaaccgtgtcaataaggatgcgcacgccaacgcccataaccgccgcaccgaaggcatacgagagcgtaagaatggcgacttgcctacgcttggtgaaccaatacagtggcataagtacgccgaatacatgcatgccgacgtatgaaggttcggcaaagaggaactgcacatggttgggcacgtagttacgtttcaggatgcgccgtgcaatccatgtaattgcgggggcatgtccgtgtacggcaaggaattccagaacacctattccgaaagacacccaatatgcgatgacgacaagtctgatcgcataagtccaatccagttgtttcaaccgaaacgcaatgtccagagaaataaggcacgatatgcccgaaagaagcgccacaagtgtttggaacgccgtgtgcacatggaacccgatgctcgcccatccatatacggaaaccactatcaatgctgctggatacagcattatggctccataacgggagaacacgcggggcacaaatcgcacgttaagcagcacatggaggacaaataacacaggagatatcggactccaatacatcatagagaatccgaataccgtgccacctgcgggcagcagagctagcgccaggcaaaaaactatgtccgtagggtcagagaccaatccggccccaaataatctaagatgatcaactaacctgattattctttgcatcatcattatatcaatttaagttctatgacatttatatcgtaatcaaattctcttataattccacgagataaaaagttaatagaccacgacgtcggaagccatcaaacagctatccgattattatcacatccgacgatgacgacaccgttttgcaggacgccttttaatgaaaattacagtgaagacaataatcagtagaattatgaccgccggcaccacaattacaggcaaccaatgattatgagcattgcccttggttttcacctttacggattgattagtctcatcttttgatggatctaatggcaaattggtagtttgtatccactgctcagcagaatccgctgcaagctcatgtcccttcacattaggatgtcgattatcggcttgccaagtatcatccccttctatccaatgttcccagtcatctggaacatttaccgaagaaaaagccgtaatcgcagtgaccagcgcttttgctccagaaccccattgatcaagaatttgaacattatcgggacttctcggcattatctccggaacgaagtttacttgcgcatccggattctctttcacgatctttccgaataggtccctcgccgcagaaataatatcggttaccgattttcctgagttaacatcattgaagacaccaaccacgaaaatacgcctaatcttatttttatcaacttcgttaactaccctgtcatattgtttgtcatagctaaagttagttaggaacccagctccaccatgagcataattagcacattgagcattatcttttccgcaaaaaagatttgcccaagtatctaatttctgaacgatggaataatcgccatatttataaccggacagaccggttccatctgtagtagaatcaccaatgaatacatctatgttgcgctcagcagcaaccgattcagcgtttgcaacggcagagtaacaaaagagtgaggccaccgataacactatcgaacataatataaaaaatatgtgtttaaatttatctctcatatcaggctttcttcctcataatcttcttcgggaagacgaaaacaaagtaagaaataattgatgcaactgttccccaaatgaagaaattaatcgaaaccatcaataatggatttatgtccggccaatatgtataagagataaaggccaatggctcatggaacaggtatacacctaagctaacttcagcgagagtcctggtaaatttgtttgatttattgggcatgaggaagaagataaccacaaggcacagccaaacagctatcaactgtacgaacgttccgccccttcccatgtacatgaagccaatggctatgagcattaggacaaaaccaaccaccagcaaaggcttcgttatatatttacgtattgtcgcttcatgattaaacaggatgaatccgagcatgaagaacgagaaatacaggaagaacggggagagagttggactccgcatcaatgatgctccatgccatgtgtattttgtatagaaaataagcatcattacgcttatagcaaatgcaaatatatcagcccacttaaattttttaagacaaaaattaataaaccacgcaatcaaggaataaaagaacagtgtaggaagataccaaagttgtccgttatcatatcccaagaagatatttttccataaaatataaagaaaagattgcccttcataaccaggatattcaataagtaagcgaataggaatcatccaaattaacgcaaccaaccaatacggaatcaccagacgactaaatcttttaataaagaaatccttgaatcgcttttttccacgaagcgtaaaaccaacgcaaaatccgctaatcagcatccagagacccaatactaacatagcaagattcccgacatgtgcgaaaacaggtgcctcttgcgttgtcctataatctgtccaattgtaccaatatatggttgtactatgaccaaatatgacggcaagaatagctacgacccttagattgacgatatctgatcgtaatttcttatcgcccattcttctccaatcaccctactgcggaaacctgtgaatgaaaatacagttcactagtgacctattttggcttagtctaccccattcatcaaacagatgccgcttatcagacatcggaatgtgtatccatcgccaataagcctataactatgaacgtcagcatggtatggaatatccacacgctgctagctgttctattatttacatgcagcaacaaattgttgatacatggaccgcatgccatacagttgagcacgtgctagaccagcttgagacattttgttgcatcgatcaggattgcgttgcaaagagacgatagctcgcgaaagagattccactatttgaccatcgcgttcaacgataactgcacactccggagatgtatattcttcgattccgccggaacgcgtaactataagaggtaaccctgcggccatggcctcaacgggaacgagaggagctgcatcttcccacatagacggaacgacttgtatatcggcggatttaagatatcgatacaattgatcgttggggacatagccgatatatgcaacacgattgccaagatgggacactctctcaacaacggcatttacatagggagtcctattggatggaccgaagtcagcactgcctacaatcatcaatttgacatgttgatcgtcgatttctgatatggcctgcaatagttccaacacacctttttcacgcataatgcggccacaaaaaataacgataaaatcatcatcagtaaagcccaatgaacttctgattcttctgcgctccgcagcatcaacatgacggctaaaacggctcatatctattccattgtggacggtaatcactttttgctgtgaggtgcaattcatacaccatgctttgccaacaaaatcactaactgcaaagacgcgtgaggcactgctggaaaatggtttatcgaacgttggcgtgtagtgtaggtgataccacattttaccgggaaacgaatcatcaaatgccgttataccgctagaaggtccgccttcaaacactacaccgtcaaaagattcatgacggatatcacgtagggcaacatcataaaacgcagatggtgaaagcctttgagaggggaagaatcttcgaatgaatacatttttaacgcgatgtttcaaacgttcgaatactgttgtagatggtattaaaacaaatttcgtgtaatgcaatgactttgcaagtcgttttgattcatcatcgaatgtggtgactactgtgagatcaagctctttatataactcattttgattgacaatcgatgtcatcaacgtctcaatagcgccaccctgcgtcgccggaacgggaaggagcccaggcgcaatcaaacaaatccgttttaacggcatattcatctcccatgctggatactagagcgagacgactcaattttatctcaatacacaaaactctactcttaccatgtatctttatgaggggaaggcattatgcaaccaattcttctctggcacacagccgactgaaaaatatgcaatcatgaacctcgatatataaaaccattatctcgcgctccatcacttcaaagcgaatcgacgtttatcgtattttttgagcgtgtaatttgggtttgctcgtcattgaagaaacgagcacgagatcccggcccgtcggcttggcccggcggggatgcttgcctatggaagacagacttgacatggccaccaggcgaaggctcacgaaccgtttgtatttcgtcaagtcggtgtttcgtgtttagtcatgtatttttttcgggtttagttcggcgtaccggtaccgggaacgccgaaaccgaacagaccgccctgctggggctgctggccattctggccattctgaccggactggctggcaaacgggttgccgttgttctgctgcggctgcgtgggcggattgaacggattgccgttaccctgcggctgtgggttattggtgtagtaggggttgcggttgccctgctggccctgtggggtttgctgtgcaggctggccgaacgggaattgctgcgtgggctgggcattgttgccggcctggccgccctgctggccctgtgcctgagtcggggtcggcccataagcgccgtattccggggccgggcggtacagcggagttgtggccgaggtctggtctgcggccggcgctgccggagaagccggcgaggaggagaccaccgtgctctcgcccttggcggaggcgtagtccgggatgggctcggtggcggcttgcgtaggctgctgatcggcagcgagggcggccgaggaaaccggggcttgctgctcgctggaatcgctggcgttgccggcatcaaccgagtcgccacccacaaacgggttcttcggctcggcgttgccggtatcggcagtactattggggttttcgttattccgcggggtctggtcgacgccctgcgggttaaattcgtcagccattgctgctccttttcctaaattcctatcacgtctgttcggcggctattcgggcacttgcccattgccacttctcgtgtgctacctcagtagtaaaggcagtcaatctggaggttttctgaacgttgattgaaagtctatgcgtaatcatcgcagagtcttatgggcatctcggcttcgaggggctgatttcctgtttcgggaacatctacttgcacttcaaggggctgttcgcgcggtcaattccgagtatcaagggccctcatttaacgccattccgccatttttgcagccggcctacttgaccgggagccccttgaagcggaagtagacgttcgggagcggcgaaatccgccccctcgaaaccgagttcttcacaatttccggcccttttctggcccttctgcctaaagtgaacatatgacgatcagccttcttgaacatccgttgggcgcacagcccggacagcccggcgaccgcagcgccttccatttcgaaacgatcacccgcctgccatccacggccagcgggcttgggcgagacggtgcccgatacggccgcaccggcatcattcacacgccccacggcgatattcgcacgcctgccttcgtgccggtgggcacgcaagccgcgatgaaggccgtgttgcccgagcagatgaaggatctaggcgcacagtgcctgctggccaacgccttccacctgttcgagcgcccgggcgaggacgtgctggacgcggccggcggcttggcgcgtttcatgaactgggatgggcccacgttcaccgattctggcggtttccaagtgatgtcgctgggcgtcggcttcaagaagacgctggcaatggacgtgaccggcatgaagtcggacgacatcatcgccaagggcaaggagcgcatggcctgggtggatgaggacggcgtgacgttcaagtcgcctttgaatggtgacgcacatcgtttctccgctgagatttcgatgggcatccagcacaaaatcggcgcagacatcatgttcgcgttcgacgaactcaccacgctgatgaacacccgctcctaccaggaggactcggtggagcgcaccttccgctgggcccgccgatgcgtggacgagcaccagcggctgacggctgatcgagtcgggaagccgtatcaggcgttgtatggcgtggtgcagggcgcgaattacgaggatctgcgccgacgtgcagcctcgcagatcgcctctctggacttcgacggcgtgggcatcggcggcgcgatcgagaagcgcatcatcggcgacacctgcgcatggatctgcgacgcgatgccggaaaaccgcccacgccacgtgctgggtatcgcctctgtggacgacatcttcgcctgcgtggagaacggcggcgacaccttcgactgcgtggcccccgcacgctgcgcccgaaacggcgcgatttacacgcgcgccggccggtacaacatcaagcgtgcccagcataagttcgatttcgggccgctggaggagggatgcgactgctacacatgccagcattattcgcgcgcgtacgtcgaccacctgctgcgcgcccgcgagttcaacgggttcacgttggccacgatccacaacgagcatttcttcgtgaagctgctagacgacatccgcgcctcgatcgacggcggatactttgatgagttccgcgacgaagcgctggcccacttctacggcaacggcgagcgccggccagggttgtgagtttttctccttcgttgcggcttgtgctgccacgaagtgactgaggggagtgtcgccaccgtcaaagatcacggcacccgcagaagacccacgagcgatatatccctgccgcccatgcgacacgccgaagattgcatgattacccagccgggtgtaagttagtcgattgtctgcgagtgtggcggaatggtagacgcgctgtcttcaggtggcagtgagtgtatgctcgtgggggttcaactccccccactcgcaccagcaactaaagggctggagccggaaggttccagcccttttgctttgtccgggcaagcgccgtttttcaagttgcgatggccttgaggggggcttaggacttgagacttatggcccaactttcgtggcggaaaatgtcccggtacctgcatcaatcgtttgacgttcaagccaggccagaatccgctgtcccggttcgcgatttcgggcgatctttgcaaaccgggacaatttttgttgccccggtataaatgtcaatcgatttatgcgaaaaccgggacaacgtgccaattccagaatcggccttattccgccgattccgtctgccagacgatatgagttgaggaaaccggagtgtcccggttcacgaaaacaagccgaaatcgccgaccgggacagcggattctgccccggtcgacaggtcaaacgattgacatatgaaccgggacaaatacagatcagagagaagcccatgaagtagatttaactttcctcaactttccgtccgccataaactagcattacatagcatcatgaaccgagacgaaatcaacgaagcatttggagtcaccgacgaccagctcgaccgaatggccgagccgtacgaatccgacaattggcagggcggtgtcgggagcatcattcgcagcaatccgaaatcaggaaccagcacaagtcggaccccagcagacacgcataatacgagttcacagacttagcgatgcattccgcaaccgtaccaccgaataccacaccacggaagaactgtaagcattacgaaatcaaccttgattattgcgcgggcctatactaggttacggcagcgtaagttagtggccgggagagcgtcgccggccatagcgaggtgatcggtatgagcgtttccatcaacacgccatctggacgaaccatggcttccgccgcaacagttgtgtcttccacaaccgcgagtcaaaatccagcgcaagcaccagccccaccgcactggatcgcgcatcagctcagtacaggggccgcgcaatcgcgctatcgccaagccaaggcgcgttgaaggcgatcaagcgccagatcgtccccgttgatgcattcggcaatcgcaagccgcgactgcgcggatggctgcacgtcgtgctgtgcggcatcgattattcgaacatcttcctcatcatcgccggcgcggtatgctttgcgctacgcaagccgaaccccgtccccggctggttcgagtttcacgaggtgtttcacttgggcacggtcatcgggtatgcctgccacgtcgtggcgatttatctgattgtctgcgcgctgtaggttcgctcgcccagcaccgaggcgggccttcatacgttacgagataggtccttgaccagccagccgtgacgaccgccttcatagacctcgtcagtgagccggtagccgcgctgttcgtagaacttgtagtggtcgttttccgagtgcacggcagccatggttccgccggcttgcgcgatgcggcgttcggcgtcggacagcagccgcgagccgatgtgcctgccttgcgcttcggtcagcaccgcgagccgcgcgatgacgtatcgcccgggctggtcgggatggtcggggtccgcatagaaccggcaagtcgccacggggcgattctggtcgggctggccggactgaatagacgaggccgattgcgcggacaggccggggcgattgggcgcatcgttcgaatcgaacgccagcagatgcacggacacggcatcccattcatcgaattccggccgccagtcgcgttcgcggatgaacacctgctcgcgtatggcgcgggccgcgtcgggcagccggtcgtatgcttcgattcgtatggtcatgagcgccagtgtaatgcgtcacgataaccgacagagtgcggcttgatggacgagttctggcccaggtttggcctgtgctcgatgagctcaggccgtacgcgcgatctgcacggcggtgccggacgcggtgaccatcagcataccgttgtcggcaccgagcacttcatagtcgatgtccacgccgaccacggcgtgcgcgcccatcgcctccgcgcgctgctgcatctcggcgatggcctcgttgcgggcgcgcatcagctcctcctcatagccctggctgcggccgccgaacatgttgcgcaggcccgcgccaagatccttgaacatgttcacaccggataccacttcgccgaagacgatgccctggtagttggtgatggtgtatccgtcgacggacggggtggtggtgacgagaatcatggcgaggctcctttggcttgtctgcgtggatgaatcactgccgagagtcggatcgctcccgaatctcacctcggaaacggatcgcttctcttggctaccacaatagtcgagagcgccttccccaacatcttcaatccacgcgattgcgtaatcaaacacatgtttcgcctccaaaaaatgctgatagacattgggccgcaaaaggccagcctcaacgggcgcaagccgctcaccaaactgaatcgcagacccaaatgactcgtcatgggcaaacggctggaccacccaaattccgctgcgataatcaaccatcaccgaaagcccaggctgctccgtcgatacgaccatcatcgaaccggacacgttctcgacattgatattcgggtgcccgtacaacgcgtaactcaaaccatcatcggcaacaccctgctcttgccaattggcgcctaagcactccaacatctcgctgggcgagtacgcacaatcttccgcataatcaatcggctgagcatccgtataacagcattcaccgccgtcaccttccgcaatgctgcgctccacaagataggccatcacatccggcatctcccaataatcaatggacagcttatcaatacagccgtttttccaagccatacccggattcaacttgtaagtgcaacggctggtttcgggtcggcttgttttgatttgcctcccagtcgcgcgttgaccgcttccagatagtcgcgtccgagcgtgccgacgagaacgccggcgatgagggcgatgatgccgatgaacatcgacagggcggtgaggctggtacgcaacgggttgatgcgcagatccttggcgatcatgcggatcacgacagtcgccccctgtcgatcgtcagtcggcgttcgcatcgggcggcgagctgcgggtcgtgcgtgacgaggatgagtgtgaccccgagttcacgaacatgtcggaacagtatgtcggcgaccatgtcgccggtttcggtgtcgagcgcgccggttggctcgtcgcagatcagcagatcgggatcgcccaccagcgctcgggcgatggccacgcgctgctgttcgcctcccgacaggcgcgacggcatgctgcacaccgtccggctcccgagcccgacggtgtgcagcatgcgcgaggctcgtcttctgatgacccgcagggggatgcctccccggtattgcaatgggagtgccacgttctcccatgcgctcagatgcggtatgagggagtagttctggaacacgaagccgacatgccggcagcggaagcgcgcccggtcggcgtcgttccacgcggcgcagtcccgcccgtcataggagagcgttccgtcatagtcgttgttgagcagcccgacgatggaggcgagactggttttgccggatcctgatttcccgatgatggcggtggacgttcccctctcgaacgatgcgctgacatcgtccaccgtcgtcaggcgttcgccgtcgggcagccggacttcggcgctcagatgttccaaccggatgagtgtgctcatgattgcgctcccggtgtgagattcggagctgtcgcggacaccatgtcaccttcctcgagaccgtcgaggatgatgatcgacgtgccgtccgatgcccccaacttcacgttcacggtggcgaacgaatctccgtcacgcctgctgacctggccggaggcgagcctgccggcgactgcggtgacaggcaggatcaaggcgtcctcgaccgcagtcgcggtcagtaccacggtggcgttctgcccgggacgcgcctgcacgtcctttgggaacaggcattgcagtgtgcgagtcgattccgtcccatgcgcagtcgtcgccgatccggccgtatcttccgctgaagagggcggagtggcgacgccgtcattcactaccgcggcacagtccgtgggcccctgcgcgtcggtgatctggaatcggcccgtcaacggctggtccgggtctatggtcgccagcagcgcggtcgcatccacgctggcgctcatgccgccataccgtatcgagaacagcggatagtccgcggccatgtcgttgtcctgcgcgaccgtttcgatcacgccgtcgaccggagccgtgacctgctgatcgccgacggtacccaacacgtcgcccgcatgcacgtatgctccttgatcagtcgtggagtggaaccagcctttcgccggagtcgtaagcgagaacacaggagccacctgcacgccggtggaggaagaggacaacggcgtgatgccgcccctacgcacctcgaccgtggatgctggccgcttcgccgtggaggaggcgtcggacgatggcgtccgcgacggcgagcaagccgtcatcatcgcgcacatatgcggggccgaccgtgttgacgaacagggcgagtgcgggcaggacgatgaggccgagccatttgaggatgtcgtagacgcggctggggatgagccagtcgggcacgtcatgggtgacgtcggcggtttcgggccagtcgctcacatcgacgccgggaagcgtttcgccggtgtcggtcgtgtttttgctgtcggtcatgtttgctccgatcaataagggatgatgatggggtgatgccgtcacccggtcaagcgggtggcggcatctgttgagtctcagcggcaggtcaccacgtcgcccacatagtagacgttgatgttgccggagggtacggtgcagcggctgacgctgtaaccgtgcgcggtggcgaactcccatacggtgtcgccccattggaggaccttggagactccgtgggacgatgcgggggcggtgccgccgccgtaggttacgacgtcgcccacgtagtagcggttgatgtcaccgctgggcgtatgccacgcggacaggggccaagcatcataggcgacggcgagtccccagatggtttctccccattgcatgacgtggctgatgccacccgtgttggtgttggccgggggagtgctcggctgcacgggcgcgggcgttgccggggccgtggctgtggagccggtggggttggcgtacaggtcccactgccatgcctcgccacggaaaatgttgaggtcgatgggactccacgtgttgaccacgccggtgccgctgtattggcgcatggcctcgccgtatgcgcctatcatccacgggttggcctgatagccggtcgggctcatgttcgcgtattgtgcgatccataggccgtaccgatcgcggatgtcctgcgggatggtgccggcgaccgggccggtgtacagcaatgggcgcacaccgccgctcaaccgttcgcactccgccatgaatcggcgtacccaatcccagttgccccatgcggggttgtcgtccatctcccaatccaacgccacgatgccgtgacgccaatagttcgacgtgttgcgatagaagaattgggcttccgcctccgggttgcctcccatcgcgtaatggtagaggccgaattccttgccggatgcctgcgcttgggcgatcatgcggttggcgtccgtgttgacgccggacaccaagcagttgttgttgacttgcccggtgccccatgtggtgccgacgacaacgaagtccgcctgcgtgttggcgatgtcgatgccgcactgccagttggacacgtcgatgccctgcatgtccgcgtgcgcggtcgccggaagcagcatcatgcacacggcggcggacaacgccatacccttggcgagcagacgcttccacaacggcttgtccttgttattgaccaatgttttcccctttctcgggatggattgttgtttgtggcccacggtcgtgggccgggattgtcacggcccactcggggccgtcaatggaaaagccccacacggaatggtgtggggctagaatcagtcgatcttgtacaggcggggagtgaacgtcttatcgacctcgcccgtggtgttgacgaatatattgaggcgcagcgtcccggccttcaaggggcgcggcccatagcccctaggttcgaacgcgattgtctgtccgctgccgtcatcgtgggtgagagtggactggatgccaatcaaccatgagctgctgtcatacggccagtcggaggcgtccagcgtgtacgtgcccgcgtccacatggacggaacatgtcaggctattccacgagtcaaccttttgtgtggtggagcctttgaaccggtacgtgcccggcgatggttccgtgaccataacacccgggtcggtgcctaatgttttaggcagtccggtgacacgcggatacaggttcgctaattcacacccccccccctcaaggcttgtgacatcgggtttcatccactcgtgcgcggtgttcccgagttcgagttggattttcaggttgcccgacacgctgccggccgtgacgccgccacgcaagatgcgcagctcgacgcgtgtggtccccttgggaatggtgaccacggtgttgtttttcccctgatagacgccgccgaggctattcgcgttggcgtagatgccgatgaccaggtttccgggcacatcgcccgtgtaggagatgatgagaggcacgccaacgatgccttcgggcacgtcgaactcccagcgcacgcccttgtacaatggcaccgattcggtgccgctgctgaaatcaagcgacccgtcctgcgccacggtgacggtcagaccgttgcccgacgcggggccataagacaacaggttacgggagagcactgtgacgggcacctttttgctgatgttcggattggttgtcgacttgatggcgattgtggtggttccgggttccacaccggtgacgcttaccccaccactaaatacttcatcagccatggttcactccttttcgagagatcgatgcgatggacttgtcagcgacagtcgcggtcaccgtctggtccgcgccctccggcaggaccttgacgtcgaggcccgcggtctcgccgaccctgagtgtcaacgactcggcgtgacctggatgccggtcggtttcgcgtcgccaaccacggcgatatccggcctggcggcgctggccgcgaactcctgcgatgccgcatcgggcaggatcgtcaccttgaggttcttgctctcgccgacgcgcagggtgatgttgtcgatgggtttgccggaatcgtccgtgaccttgatggactcgggcgcgtaggccgcgctgatggacacggcggcggaagtgaaaccgttgaccgtggccgtcaccaatatggttccgccatgccgccacgtgagcgtgttgcccgaaaccgtggcggtggaagtgtccctgctcgcgaacgtcacgtccttggtggtgagcaggtcgccaacatgaccgtccgcatacgtggctttcgccccagtttcagggtgccggatacggccagagacttgggcaacggcttgcccttatcatccgtgatattgacggagacgaccgtgtccttgtcgaggggccatacgagtttgccgttgaacatggcgttgtacgtgtggcctcccatcaacggtttgccgacacgtttgccggcgtaaaaggctggcatggtcaggctcccttcacggtggccttcttggccttggctggcgtggagtccttgccgggttcctccgtggtttcctcggtggtgccggtgtcggtggtgccttcggtggtgccggtggaaggcagtacggtggtcgcagcctccgccttgtccttgaccgcctgcaccgtcgaatcgatggtggcgatagccgattcgcccttcgccgcaaccgcgttggcggtgtcggccacggtctgcgaatcattggcgacgctagccgccaacgtgttggcgttcgacgcgaggatattaaggtcggactgggtggcggtcgcggaatcagccgaggactgtgcgctcagcatggcgctcctagccaacgcggcgttcgtctgcgcttcggccgtgatggactccaacgtgctcatggccatagcggccttcatggtcgtggctgtctcgtcgaagagcaccaccgcatccgggtatcgggcggaaagcgtctcagcctccgactgggtggaagcgtggcgaaccttcaacagttgggagccggccatatccttcgggacgaacgtgccggcgtccacttccacgaggtcggcgtattcgaccttggtcttggagtccggcacttcgacgtagcgcgtgtacgcctgcggcgtgtccgccaactcgatgacctgccaaacaaacgcgctagtcgtgggcagcaggtcaaccgtcagctcgccgctttcggacaggtccgcgtcgaacgaggccgcgatgatgaggttcttgtccgcgtcgaaatggcgacgtaccggacggaatcgcatcaggccggtgaccgggtccaagccgccggtcttcggcttcctgatgctgatatggatttgggtcatgattattactcctccttaatggattcggttatggtttccggagctacgtccgggcgaagctcgtccggcagcgagggcttgggatgacgtttcaaattgttgaccatgtttcccttttctctgggatggatattgtttgtggcccacggtcgtgggtcaggactgtcgtggcgctatcggcgcggattggatgtcattgttgagcgatgtcccgtggccgttgccgcccaggctgtggtagctgtcgtagaggcgttgactgcgtgatttgaggtcctcgtccgccactccgtcgtgctcgatgaccatttcgcggcgcaggtcctccaactggcagagcaggagctcgcgcaggccgttgaccatggctttgccccaccgccacatcaggcccaaaaccgtggccacgccgccacagataaaaggcacgagccaatcgacgatgtgagcgagcaaagacattggaaagctcctttacggtgggaaaacccacacgttcgtccccgttggataggccaacgggcgtgtgggttttcggaggttgaaaatgctgttacgagagttttggaacggccggttttggccgtattgcacggcgaatctgcgtgagtccacgtgtgtcggctatgagtcggcgtggcggttgcacgtggccccgaggttcggcgcaatgcagatggaatcgataagcgttgaattggtggacaagtggctcgtcgggttcgccagttcgggcgcggcgcgcaaggcgtggagcgtactacgcgcgatactgaggcgggctatccgctggaatctcttggacgtggatatcacgagacgcgatatccagttgccggccaagcctcattacgagccggtgatattgggcatccgtcagcagcgatcgctgttgcagggcttttacgaccatccgcttgaggcgtggcttatctgtgccgtctcatgcggactccgcaccgaagaaggatacgggctcgaatggggcgacctcgacctgcggcgcggcgtcctgcacgtggagcgcggcctgcaatgggtcgccgggcatgaggccgtcgtgccgccgaaaaccgaactgtcccgccgcacgctcccgttgccgcgcttcgcggtcaaacgattgcgcgagctcaggccacgcgaggggggccgactcatcggcaccctcaccccgccgcaagccgcacgccaatacaaggcctactgcaagcggcatgatctgccgcatgtgcccgcacgcaacctgcgccactcatgggcgacgaacactctggcggcgggagcggatatcgccatcgtgtcgaaaatgctcggccacagcgatatcaaaaccaccgcgaagtactacctcaaaccggatatcacggctttgcgagacgcgcaacgcctctgggaacgagccctaatagcctgaacgggattccctaacccatgcggggccgaccgtactgacgaacagggcgagtgcgggcaggacgatgaggcccaaccatttgaggatgtcgtagacgcggctggggattgcgcggttggcttcgatccgacgacctgcggttttggagaccgccgctctaccagctgagctacgcgcataggcggtcatgccggttgattgccatggcacatgaccattgggtggatatgagtaaagcccctgaaccggttgattcagaggctttcacactaatcctgatacggagtatgccacggggtggattcaccctactcccgcttgtgttttgttttttcaggcggcttggatggtgaggcgtccgccgagggcgtggattaccttggcgatggtttggaagctggggttgccgtccttgctgaggctcttgtagaggctttcgcgccccacgcccgcgtccttggcgatctgggtcatgccccgggccttggcgacgttgccgagcgcggcctgcatgagtgcggggtcgtcgtattcggctatggcgttgaggtaggcgatgatgtcctgttcgttttcgaggtattcgctggtgtcgtagtcggtgaattcggtgctcattgtcgttgttccttgtagtcgttgaggatgtcgtgggcttgtctgatgtcggtctgctgggtgcttttgtcgccgcctgcgagcagcagcatgagcacgttgccctgcatggcgaagtagacgcggtatccggccccggtgtggaaccgcatctcgctgaccgggcctcccacgggtttgatgtcgccgaatggcctgcctgcgagcttgcagacatcgagccgggcttggatggcggccttcgctttgtggtccctgagtttcttgaaccacttgcggtattcggcggattgcttgatttccatacctctattgtatcctacagactacatcatgtcaagccgaacggccgctggagcccatagccaacgcaagaatctcccgtatgttgaactcccagtagccgtcatcgacgggtctcgagctggggagtttgccccggttgagccagttgctgatccgcttacggctgacctcgtacccgtagtttcccttgagccattggctcatgcctgccggtgtcttggtcaggtgtattgcctcggccttgtcgcggctctgctcgcgcagctcctgcacgttgatgggattgccgcacctgcacaggcgcagcgcctcgcccttcgcggccatcacttcgcgtctgcattcggggcagacgccgattatcctgcgggtgcgcggcctgcggtcaaccttggcagagcgtccatggtgcctcgacctgctggctgccgcagtattggcatggttcggtggtgatgactgcacacgttgtactgtagggaaccatgaaagtcgtattgcaacgagtatccgaagcgtccgtggacgtggtcaatgagttgggcacgttggatcccacgttcgagccgcagcagattggcccgggattcatgattctggtgggcgtcaccgatgaggacggcgacaagcagatcgcctggttggcccataagattctgaatctcagggtgttcgaggatgcgcagggcaagatgaaccgttcgattcaggacatcggcggtgagattctctccatctcgcagttcacgttgttcgccgacgtgcacaagggcaatcgcccgagcttcatcaaggccggcaagcccgagcatgccgatctcatgtggatcaagttcaacgaggcgttgcgctccgggggagtgccggtgaaggaaggtcgtttcggcgcgcatatacgggtcggactggtcaatgacgggccggtgaccatcgtcatcgacaccgaaactgatatgcctgacgggtcccgctgagccaagcgacaagtacatatacgaaaagccctgtgcggatcattcgcacagggcttttcgtatatcggcttcaggaagccgcagccaggccgatcgtcaggccttgacggctgccttcttgccttcgatgatggccttgtatccaacgccgatgaccagcacgtagatgcagccgacggacatcacgatgatggcgccgagctgggcactcatggcgtcggccagggcacccatgatgggcgggaagatggcgccgccgatcaggcccatgagcatcaggccggagatttcgttctggcgctccggacggtacatcagcgcgtgggagaggaagagcgagaacacgttggagttgccgaagccgaccagggccacggccacccagaacagggcgaccggcgggttggaggtgatcgagcagaagatggcgaagcagacggtggaggcggtcatgatggtgccgcacaccagaatgccgacgcggttggaaatcttcgagagcacgatgccgccggtgaagcagccgatcatacgggccacgaagtagaccatggtggcggtggcggcgatttcggtgaaggtgtcgccggtgtgctcggtgaggatacgcggcgcctgggcgttgatgccgacgtccacgcccacgtgggccacgatgccgaggaagcagagcagcacgatgcggtcggagaacaggagcttgaagcagcggccgatggtggtggtgccggcgtcgggggcgggttcgtcgatcttgtcgatggcgagcagcacgtagccgacgatgccgacgaccagatagatcacgaacagtatccaccacatgccgagctgggtggcgccccagatggcgatgtacggggcgaacagggaggcgaaggacttgacgaactggccgagcgtcagggtggaggcgagcttgtcgcccttgacgaacacggtgagcagcgggttcagagacacctgcatcaaggtgttgccgataccgaggaaggcgaaggagatgacgatgagcaccagacgtgcggtgccggatagggccacgtaggcgatgatgggcagtgccatggcgaccagcgtcacgagaatggaccacagcacggtcttgcggcggccaatcttgttcatcagcatgccggtgggcacggcgaagatcaggaaccagaagaacaccatggtggtgaacaggttcgcggtgccgttggccagattgaactcagccttgacgtagttcgtggcggtgccgaccaggtcgacgaagcccatgacgaagaacgcgaacatcacaggcgcgatttttacgagaccggcgttgccggtcttggtggtttcgctactcattttgaattccctttttctctatgaatggacgtacgacagatctatcggtcaatggatgatgactagtgaatagtgatggttccgttatcggatgtcatcatggcgttacatgatttggcagaattcgatgacctcgtggttcggcccaagcacgttgaagtaacggatgccgttgctccagaaggtgtcgatgtgctggatggagccttccacgaagttcaggccgagcttctgggcttcggcgaaggacgcttcgatatccgtcgaatccagcgcgaagtggttgatggcgccgttttccataggcgtggggttcatggtccacacctcgagggtcaggttgttcaggcgcaggaaggtgcagcggtcctcaccgttgggatagatgccgaggcattcgaagccgagacgctcgtagtaggcgatggtgccttcgaggtccgtggtcggaatgccgacatgctggacgccggtgacggtgtcgcgaatggacatggtgactcctctgaacaagatggctttgccggtatagagcggcaaagccatcgggaaaatggggtgggggtggattacttgccgatttcagccagatagtcgggcatctcggccgggtactgcggccaggcaccggcctgggtgcagacgaaggcggcggtgttgacggccttgcggtgggcttcggcgagcgtgtcacccagcaggatgcgtgcggtgaaggtgccggagaaggagtcgcctgcgccgacggtgtcgttcacctcgacgcgcggggtgtccagcgtggagacctcgcccttgcgggagatgatggtggagtaggcggagccggcggtcagaatcacgtagtcgaggtcgaattcctcgaggaaccagcgggaggcgtcttcaccggaggtgccgcgaatgtcgaacatgtcgcgcagcagcaggagttcctcgtcgttgatcttgaagacggtggccaccttgaggagttcctcgataagctccttggagtagtggtcgccgcgcaggttgatgtcgaagaacttcatcgcgcccggcttggtgtgcttgagcagctccgtgatggtggcgtgcgattcgggggagcgcagggccagggtgccgaagcagacggcgtcggccttggagaccacgtcgatgagctggcgggtgtacaggatgtggtcccaagccacgcccttgacgatggtgtactccgggatgccgttcttcagtgcgacctcgacggtggaggtcggccaggcattgcgctggatgacggtgttgataccggcctcgttggccttggcaatcagttcgtcgccgagttcatcctcgccgaccgcgctgatggcccagccttcggtgccgttcttcatcgcgtggtaggcgaagttgacgggggcgccgccggctcgcttgccgctcggcagcatgtcccacagcagttcaccgaggctcagaacgatcggggtagtcatggttggtttcctttcctttgtttcctttatcgggtgtttcgtatggaaaatcttgtgatgtcggcgcttggtttaggagacgtcgaagaacaccgaggggtgttcgaggaattgggtcactgccactgctgcggcaccggagaccgccgcgtcggcggacaaggtggataggctgatggaagtggaggcattgatttcggggatggcccgttcggccaccgtggcgcgcacctcatcgagcagtatcgggccggcttcggacacgatgtcgccgatgatgatgtgctcgggattgtatccattgaagatggtgacgcatccgtagccgacgtatcgggcgacttcgcggacaatggcgattgccgcttcgtcgccgtcgccggctttggcgaacagggcgcgggcggcttcggtgtgggtcatatcggccgcgccgggaaccacggtgccatcggcgatgagcgtatcgtgaatggcgggggtggagcagtagcgttcaaggcagccgacgttgccgcaatcgcaggggcggccgttgacgtcaatggagatgtgtccgatttcggtggcggcaccgaggaagccgttgatgaggcgaccgttgtcgatgacgccgaggcccacgccttcgccgaccagataataggcgaggttgtcgtcggcgtgcaccgacgggtcgaagagataatgtgcgagggcgccggcgcgggcgtcctgttcgatgaacactggcacgcggaaagcggtggcgaattcgtcgatgaagttgattttgcgccagccctgcatgttggacaccacggcggtgcggcctacgttacgcagataggggccgggcactgccatgccgatggccacgatggatgggtcgttgtcgagcagttgttcgacgcgctggtggatggtgacgatggagtcgttgatggtgttgtcgcacaccgtgggcaggttttcaaagctcagggtgttgccacacaggtcgaacacgccgatctgcaccagcgagcgggcgaatttgatgccgatgatgcggaagtgcgtggtgttgagcttgagtccgatggaacggcggttcttggagccttccagatcgccggtctcttcaatcatgccggcctcgataaggcgtgcggtgattttggtgatggccgcgggggtgagttccagtgccttggcgatttgcgcgcgggaactgatgccgttgtgatacaggtgcttgacgatgcgggagcggttggattcggagacactggcctgggaagtggcgtgggtggtgtttgttgccatcggtcttaagtcctccttgtctgcaccgctgcgagttgttccgctcgtctttgaatctgaacttgattaagatattaacgctgttaattgattgacgcaatcaatatgtcattcggcgtgtcgtgcatgtgagtgtcgtcttgggtgaatttgttaagatagttgtcaatagtcagatgtacactgatatcaagcgaaacgttcgatgaagaacaggggaggactgatgtccgaaaacactatgaacaatctcaaaatcggtgttgacgtgggcggaacaaaaatcgaagctgtgctggttgacgcaatgggcacggtattgggttccgcccgtattcccgccagacatggcaacgatgccgtgatcgaagacatcgtcgctgtagcgcatcaggcggcgggtgagcgttttgacgaggtgagggccatcggtgtcggtaccccgggcacggtggattcggccagcgggcatgtgggcaatatcgtgaatctcgacgtggtctcgctggatatggggccgttggtctcgcagcgttcgggcgtgccggcccatgtggaaaacgacgtcaatgccgccgccgtcggcgcggccaccgtattgggcggtgcggacggcatggccggtaccattgcgttcctgaacttcggcaccggactggctgcgggcatcgtcgaaaacggcgtgctgatgcatggctatagcggcgcggccggcgaaatcggccatatcccagtcgaacctcatcgcctcaagtgcccttgcgggcaatacggatgcttggaaacagtctgctcgggcgcatccgtggggcgtctgtggcccaacgccgacccgccgatgcccgacctgattcgtcgcgcgaaaaagcgggaggccaaggccgtcgatgtgctggacatggtagtgcgcgccatcggcgacaccatacaaatcctggctcagtccgttgatccgcgactcatcatcttgggcggtggcatggccaaaaccggcgaaccattggtcgaggtgatcacggctgagctgcgccggcgcgaatcgcaatgccgattcctcgaaacgctggacctgccggcccggctgcgtctggcacctgtcggccaaccagtcggagccatcggtgccgccatggcggcgtagcctggcatagtgccggggcatgggagatgaggcctcagatttgtctccgaggccccatctcccacgcagtcctatatcgctttatgtcgtgctgtgccgcgcttggtcttgcgcgtttcgttgccggggtgaccggcttttatttggccaagtgttggaagaccacggcgatggcctcgccctgtacggtgatgtcaggtccgcattcgcagcgccgaatcaccgtgtgtttgtggaaggacgaggatgtggcggcatccagatattgctgggccgcgccgatgaacgtcgcgttgatgatgttcggctggccatagacgcatacgtctgccatatccaaaaggcccacaggcatggccagggcttggccaagatagcggcccgcccgagcaaggataccctgatgctgctccacgtctgctgcgctgagttgcttcttcaatgcggttccggaaatcatcgtctccaagcaaccgtgcttgccgcaagggcacagcggcccgtcaagatcgatggaaatatggccgagctcgccagccgcgtgcagttcgccgattaccggcgtgtccgagagcagaatcgccgaaccgatgcctctttcgatgcgcacgaaaagcatattcggcccgccttggccaaagaaacgttcggtgagcatggctgcggtggcgtcgttgctgacgtttacttcaagtccgaaatgttcggcgattggcgtggacaggtcgagattgttccagccgcgcatcgtggaggagcggaccacgccgttgtctaccacgccgggggaggcgactccgatgccgatgacctcgccatcggacatgcccagcatcttctcaatgagctcgatgatcacatccacggaaacgaatgagccggtgttcagggtgacttcggcgtgacgcagcggctggccgagcagattggtgactgcgccgtgcagcaggtgctcctgcgtcaggtcgatgctgatgatgcgcagtcgatcgatatcgatgctcagcagtgtgcctcgtttgcctttgccgccgctgggtgcctgaccggtctcgcgcagcaatccttcctccagcatccgaccgaccacatcggaaacggccacgcggctcaatccggtgcgtcggccgagctcggcgcgcgaatactggttggtggggaacaacaacctgaagataagttggcggttcttgcggcgcacatcggcgggggaagccttggccgcatggtcgtcggtcgttgtgttgagaccgagatatgacatgtttcctcctgcctgatggtgagcgagtggacggcgattgttgttccatacacagcttagacggtgaagcgcaatttcgtcgttgaaactgttatgaaacttcactaataaattccagtgtacctgtgtgaagcgtcaggaaacaccgtgagtgttcataaggtccaaaattgttagtatcattaacaaatagcgaatcaccaatcggcgctacgccgaacggtggttggaacgccgcgcggcacccggacgtgacaaggatgttgccattatccgcaagacgggcggcggtacagcgactcgcatcgggcgggccgcacggaactggaggaaaccgatgccggaaatcatcattgtcaagaacgaagccgaggccggcgagatctacggccgttgcgtggcggacctgatcaaagcaaagccggacgccgtgctgggcctggccactggctccagcccgctggccgcctatcaggcgctcgccaagatcgtcaaggacgaggccattgacgtttcgggcgtgcgtggtttcgcgcttgacgaatacatcgggctgccgctgacccatcccgagtcctatcatgcgaccatccatcgcaccgtggtcgaaccgcttggcctggacccggccaaggtccatgtgcccggcgacgtactcaacggcactccgctcgaagacggcgacaaagtcgcgctggccggcccggcctatgatcgtgccatcgaagccgctggcggcatcgacgtgcagatcctcggcatcggcaccgacggccacgtcggcttcaacgagcccggttcctcgctggcctccggcactcgcgtcaagaccttggccgaacagacccgcatcgacaacgcgcgcttcttcgacaacgacatcaaccaagtgcccacccactgcatcacgcagggtattggcacgatcatgaaggcccgtcacctcgtgctgctggcgttcggtgccggcaaggccgaagccatcgaggagacggtggaaggcggcgtgtcagcgttctgcccggcttccgcgctgcagatgcacccgcacgccacgattatcgtggatgaggaggccgcgtcccgcctgcgccacaaggactactaccgttacgcctacacccacaagccggcctggcagggcatctgagttatcgtgtgctggctcccgccagcgggagcgcatgagcggtaaggagaacaacatgtctgataggaacgagatagtctcgcgcgtgaccgcggcactggagggcaagccggctccggtggcgattcgtaacgcgcgcaaggtggatgcgcgcggtgaacggcgcggatattgggtcgtctccgatgccgccggcgtcatcgtggcggccggcacgggggaggagaccttcgagcactgctgccgcacggtggggctcgacccggccgatcgcaacgcggtcatcgacgccgaaggccgtattctgacccccggctacgtggacatccacgcgcacggcgcatgggagaagagcttcgatgacgggccggacggcatcgacgtggcgcgggccggccacgccgtgcacggcaccacgcgccaggtgctctcgctgatcaccaaccccgtggacgtgatctgccgcaacatccgcaccgtccgcgccaagatggagtccggccgccccgacatcctaggctgccatctggaaggcccgttcctggccctggcccgcaagggcgcacatgacccggaatgtctcaaggatccggtgcctgacatcgtcgataagatgcttgaggcctccggtgccgaccccgcctccggcaagcttggctgcatccgccagatcaccatcgcccccgaactgccccacggcatctccgccatccgccagttcgccgctgccggcgtggtgccggccgtgggccactgcgacgccgactacgagaccgccaaagccggcttcgacgcgggcgcgggcatcatgacccacatgttcaacgcgatgaacggcctgcatcaccgcgaacccggtccgattccggccgcggtggaggacccgcgcgtcaccatcgagctcatcaacgacggattccacgtgcaggatccgatggtgagcctctccttccggttcgcgcctcaccgcacggccttcgtgaccgacgcgatggccgccaccgactgcccggacggcgcctacaagttgggcgcgctggacgtgaacgtggtcggcgggcatgcgcgcctggtctccaacggcgccatcgccggctccactctgctgctggaggtcgccgtgcgccgtgcggtgtgcgaactgggcttcagcccggtggacgcggtcgaggcggcaactctgacgccggccaaggcgttcggcttcgaccggccgaacccggtcaccggggcgccgatcggcctcatcgcccccggcttcgccgccgatttcaaccttgcggacccggccgactggacggtcgaacaggtgtggtgcgcgggccgcaagctcaagtagcagtaggccgaccggttgacgaatggaaggcattcgtctacgaacatggtcacatggtgagatgatagtatatttgtctcaccatgtgaccgttattcacgtcgtaatacaagaatccgtaatactgctcgataccgcataaaaccggccttggtcgccacaagcgaaacataagtcgatgactatggaaacgcagaggtaacacatccgcaccatagtcaggcggtaatccacgcccgcagtgatgacgtggaaacaagttatgagagaggattcctgttgaattccaagaagattctggccgccgccgtctccgtggccgccatcgcatccctgaccgcctgcggcggtgtgaaggatgacaccgccgcaggcgccgattccggcaacgccatcaccatcggcaccaccgataagatcaccagcctggaccccgccggctcctacgacaacggttcatacgccgtgcagattcaggtgttcccgttcctgtacgcccaggactacaacacctccgaactgagcccggacatcgccgccgatgacggtacctggaacgatgacggcaccgaattcaccgtcaagctcaaggacggcctgaagtttgccaacggcaacgacctgaccgcttccgacgtcaagttctcctacgatcgcatcaagaagatcaacgacccgaacggcccgagctccctgctcgccaacgtcgaatccgtgaccgccaaggacgacaccaccgtggtgttcaaggattccgtgccttttgacgtgactctgaagcaggtcatgtccagccccgccggcccgatcgtcgatgaggataccttcgacgccgacaagctcaccgacgccgacaccatcgtctccaagaaggcctttgccggcccgtacacgctgaccgccttcaagatcaacgagtccgccgcctacgccaagaacgactcctacaagggcctgaccccggccaagaactccgccgtgcaggtcaagtacttcgccgacgcctccaacctgaagatggccgtccagcagggccagatcgacgtggccaaccgctccctgagcccgaccgacatcgaggacctctccaaggactccaaggtcaaggtcgtcaagggcccgggcggtgaggagcgcttcatcgccttcaacttcaagattcagccctacggcgaatcccagcccgacgccgacgccaacaaggccaaggccgtgcgccaggccgtcgccaacctcatcgaccgcgaagagctctccaccaaggtctacaagggcacctacaccccgatgtactccttcatcccggacggcctggccggtcacgatgacacgctgaagtccgcctacggcgacggcaacggcaagccgagcaccgagaaggccaagaaggtcctcgccgacgccggcgtcaccaccccggtcgacctcaagctccagtacaacagcgaccactacggctccgtctccgccgacgagtacgctgccctgaagtcccagcttgaggcaggcggcctgttcaaggtcgacatgcagtccaccgaatggacccagtacaacaaggatcgtgtggttaccgacgattccgacggtgtgtacccggtctaccagcttggatggttcccggactactccgacccggacaactacctgtccccgttcttccgcgatggtaacttcgtgaacaacggctactccaacaaggaagtcaacgacctgatcgtcaagcaggccggcgagaaggacgagtccgctcgtggagacatcctcaagcagattcagaagctcgagaccgaagacctctccaccatcccgctgctgcagggtgcccaggtcgccgtcaccggcacctccgtgaagggtgtcaccctcgacgcttccttccgcttccgctatgcctccgtcaccaagggctgatccagcatgagctcccctctttgaggggggggagctgtctgccgacggcagactgaggggagcccaactcgtatgactcccctcagtcggcttcgccgccagctcccctcggagaggggagcctttattgctttatataccgattaccaacaccaaggagcatcgcgtgtcagacagcgccatagcgacctccagcaccactccggcgaaagccaagacgaagaagaaccgactgtcaggtagtttcttccgcttcgtgctgacgaggttccttctcattattcccaccgttttcattctggtcaccatcgtgttcttcgtgatgcgcgccaccggcgacccgatttccgccgccttgggcggccgcctgacacccgccgaactccagcagcgcatccacgcggccggctatgaccgcccgctgattgtgcaatacgtcgactatcttggcggcctgctgcacggcgacctcggcacgacgctgaccgataaccagccggtgatcagcattcttacgcactacggcgccgccacattcgaactggccttcctcgccctgattgtggcgctgattgtcggcatcggcctaggccgactcgccgcccgcaaacgcgaccgtgccgccgacgccggcatccgcaccttcgccatcctgtgctacgccaccccggtgttcttcctcggcctcgtgctgaagctcatcttcgctgtctggctcaacatccttccagcctccggccgctccgacctgaactccgaaatgcagttcacccgtctggtatcgccgactggcttctacatcatcgacgccatccagctcggcgacatgaacgtgctcgtcgacgtgctgcgccacgccgtgctgccggccgtcgccctaggcctcctgaccgccggcgtgttcatccgtctggtacgcaccaacgtcatctccacctacaattccggctacgtcgaggccgcccgctcgcgcggcgtctccgaaaagcgcctgctcaacaagcacgcctggcggccggccctgatcccgatcatcaccgtcatgggcatgcagatcgccctgatgctcgccggcgcggtcctgaccgaaaccaccttcgaatggaagggactgggcttcatgctgtcccagtacctgaaggcccgtgacttcgtggccgtgcagggcatcgtgatccttatcgccatcatcgtggccgtcgtcaacttcctcgtcgacgtcatcgccgcgcttatcgacccgagagtgaggtactgagatgaccaccgcatcccaagacaagatcaccgtccccggtgacgaccgccttaccaagctcaacgtcagcaccaagacgccgttctggaccaagatcccgatcatcaaggaactgcgcgtggcggtcggctggcagaagggcatgctgatcaccggtctcgcgatcaccgcgttcttcctgctcgtggccctcttcgccccgctgatcgccccctacggccacgcccagatcaaggccgccgacggcacgtccttcccggcgcaggccgcaccctccgccgaacacatctggggcaccaccgccgccggattcgacgtgttctcccgtgtggtgtggggcgcccgcaccgccgtcatcgccatcgtcgtggccgtgctgctctccatcttcgccggcgtgctgctcggcctggtctccggctactacggtggctgggtggaccgcattctggtaatgatcgccgacgccatctactccttcccctcgctgctgctcgccattctgatggccatcatgatctcccacggccagtccggcctgtggagcggcatcctggcttccggcatctccatcaccgtggtgtacatcccgcagtatttccgcacaattcgcgccgaagtgatccgcatcaaggaatccgcgtatgtcgagtccgcgcgcgtggtcggcgcctccacctggcgcatcatgaccaagcacctgttcaagaactccacccgcacgttgccggtgatcctgacgctgaactcgtccgaagccatcctgaccctcgccggcctgggcttcctcggcttcggcatcgagccgaccgccgccgccgaatggggctacgacctgaaccgttcggtttccgacgtgaccgccggcatctggtggactgccgtgttcccgggcatcgccatcgtgctcatcgtgctcggcatcacgctcgtgggcgaatcgctcaacgatctggccgacccgcgtctgcgcgcccgcaagtccgccggcgaagtggtcggatcgatcgaagacacgtccgtcgacccaaacgagaagccgaccgcacgcaacgaggtgatcgccgaactcgacgcgaacgtcgacccgccggccaccgtcaccgaccatgacccgaccatcgtcgcctccgaatggaccggcgagggcaagccggaaggcaaggagtgagagatgagcgaaaacaacaagaatctcgccgatatcaaggacctgtccgtctccttcatgaccgacgccggctccatcaaggccgtcgaggacgtgaacttcaccattccgcgcaagaccgtggtcggcgtggtcggcgaatccggttccggcaagtccgtgaccgcgcgctccatcatcaagctgctgccggagacggccaccacctccggtgccgtctacctgtccaagcgcgatggctccgattcgctggacgtgctctccctgagcggcgaacagctgcgcgaagtgcgtggttccgaggccgcgatggtgttccaggagcccaattcggtgctgaacccggtgtacaccatcggctggcagattgaagagggcctgcgcgcccacggcatgaaggacaagaaggaactgcgcgccaaggccatcaacatcctgaagaaggtcggcatcccggatgccgaaacccgcgtggactactacccgcaccagttctccggcggccagaagcagcgcatcgtcatcgccatggcgttggtgctgaaccccggcctgattctggccgacgagcccaccactgccctcgacgtgaccgtgcaagccgaaattctcgacctgctgcgcctcgcccgtgacgagttcgacgcctccgtgctcatcatcacccacaacatgggcgtgatcgcggacatcgccgaccaggtggtcgtcatgtaccgcggccacgtggtcgagcagggcgacgtggagcagatcttctaccatccgaaggacgactacaccaagcgactgctgggtgccgtgccgcgcatcggtcagaagctggtcgtgcgcgaccgcgagggcaaaccgatcgagcgcaaggccgattggcgcgaacagccgatcgccgtcgaggccaagaacctgaccatcacgtacccgggccatctcatgcagcccgacttcaaggccgtggacggcgcgaacttcaccatccaccgctccgaagtgctgggcctggtgggcgagtccggttccggcaagtccaccaccggccgtgccatcgccggcctgcagaaggtgtccggcggctccctgaacgtgctcggcatcgagatgaacggcgtcaaggagcgtgacttcaagcccaagcgcgcggacattggtttcgtgttccaggatccgggctcctcgttcaacccgctgatgaccatcgcggagaatgtggccgagccgctgctcgtgcaccacaagtacggttccgtggccgatgccaagaactatgtgggcgatctgctggagatggtccagctgccgcgcgcctacatgaaccgtttcccgcatgagctgtccggcggccagcgccagagggcgtctttggcgcgtggtttggcgttgaagccgtcgctgctgatcgccgatgagccgacttctgcattggacgtgtcggtgcaggccaaggtgttggagctgttcaagcgactgcaggcggaaatcggcttcgcgtgcctgttcatcacccatgatttggcggtggtcgatatgcttgccgaccgcatcatggtgatgcataagggccagatcgtggagcacggcgatgccgaccagattatgcagcacccggagaacccgtacaccaagaagctgctggcctccctgcccgtgcccgacccgcgcgaacagcagcaacaccgcgcccacctccacgagctcctagcccaagaggcgtaatcgcatagcattggagctccctcgtcagagggagctaactttatatccgctagtactgctgcccatcgaactggaacagggcgtgggcgtcgccgtgttttttgttctcgatgtaagtatggaacagctccagccgctcgctcgtgctggccgccaggggagtgggcaggtcatccagatcgaaccagccgacgctcaggctttcctcgtcgcctacgaacggctcggcattgccgccgggcttcagggcgcacaggaacgaatgatccatgtacatggtgttgtcgccattggcgtaggtcagtaccttgtttgacgaggtgacggccaccaaatcggtgacgatggcatcgatgcccgtctcctccttgatttcgcgcaccaccgtgtccgccggctgttcgcccggctcgttgatgccgtagaccatcgcccattcgcccgtgtccgaacgacggcccaacagcagttgaccatgttcgttcagtacacaaccggtcacgccattgagccacaacagatcatggccgatcttcttacgcaattccaacacaaattccggagtggacacattgcctccttagtagaaaagaagctccctcatcagagggagcttaggttacttcgcttgggcagcctgctcggccatccaggcttcgacgtcgtcgatctgcttcgggatgccggcggaaatccattcggggccgttctcggtcatgagcacgtcgtcctcgatgcggatgccgatgccgcggtattccggcggaatcagcagatcatcctcgcggaagtacaggccgggctcgatcgtgaagatcatgcccgggcgaatcggcgcgctctgataggactcgaaacgggcctgcgcgcaatcatgcacatcaagacccaggtggtgggccacgccgcaggcgagccaacggcggtgctgctggccttgcggggacagcgactcctcgacgctcaccggcagcagaccccaatcgtgcagacgctcggcgatcacacgcatgcaggcgtggtggatgtcggaataggtggcacccggcttggcggcttcgaaaccggcctgctgcgagtcgagcacggcctggtacagacgcttctggaagtcggtgaacttgccgttggtcgggaaggtgcgggtgatgtcggccgtgtacagggaatcgacctcaacgccggcatccaccagcagcatgtcgccggtcttcaccacaccggtattgcgcatccagtgcagaatcggggcgtgggggccggaggccacgatggagtcgtaaccgacggcgttgcccagttcacgggacacggcgttgaacgcgccttcgaggatacgttcggagcgcggcttgtcgagcgcggccggcagtgcggagagcagacggtcgaagccatgcttggtggcgtccacggccttgcgcatctcgttgatttcgtagccgtccttgaccatgcgtgcctcggcggcgaactcgtgcagcttgtcgtcggatgcggagttcttgtccggatcggcgaaaccgttggcctcgcggatggattcaaccatcgaagtgatttgcgggtcggtttcgctgaccacgcgcacgcgtacggcgccggcttcggcacccacgtccttggacagggcgtcggccagctgggcgatgtcgtgggtctcgatgccggtcatcgcctgcatctccttgagaccggcacgcgggccaacccagtattcgccgtagtgggcggacatgaagaagtcctcggtggagttgtcggcgcgcggcgccacgaacagttccggagtgtgcgtcttgccggcggcggcttcgggggagtcggggtcgaccgggttcaggaccagcacggcaccggcctcgtaatcggaacccagaccggtgtagtaggcgaacgtggtgtccgggcggaacatgtaatcgcaatcattgttgcgcaccttcggctggccggccggaatgaccagacgctcgcccgggaaggccttgcccagcgcctcaaggcgggctggcgtgaacttggaggattcgagaggattaatctccggatcatcgtcggcccagccggacttcatgaactccttgaatgcggccgactgcgggcgcagcgagcggttgttcacgcggtcgctcatcgactggttcgcgcccggtgccgtagcgcgctcttcggcctcatattccttgtccttggcggtgatcacttcacccattgccactctcctgtatgtagttgttgtcgaatcatcgattcccacctcatattagtcggctttatgcgatgtgccacgattgacggctgacggtaaaaccaagtacggaatttggacggtcttccggacatgcccatatggcgagtgcggcgggctggaatgcgggcccgtttattgttctcggtagggaaggagaggggcatgggcttgggctggagcttgccgattgatattgacatattctgtgggctgaatccatgtgaacccatgcgatgaaggtttatcgcgtcgcgggactcactgctatgcggaggtctccacctgaggcaccccggctttgatcagttttacccgcagcggagtacgttcgatgacgtcggcgtatgtgaaatggacgatttcggtggcaccggctcgtttcagtccctcgtcgcgtgcgcgttccttggccaccacctcctgaatgctgcggttatcggtcatggctgggtccacgtatttttgtgtgccgtcgtattcggccactatcacgcgcccgtcatcgagcttccatacgaaatcaacgcggtactcggtattcgtctgtgggtcggtcaccgttacctgaatacgcggcgtgaggaagcgatcttcgatgatggtgcctcgcgcgagggattctccgccattctcgctcctttcgtttgcatagcgcagcaggcggaatactcgggcataatcgattctccattgaacgcagtcggcggctatctcttccttggttattcccttggcaagggccgagtcaaagatcggcaacgcaaaccgaaaatcaaggtctatggcggcctcgaccaaggttctagccggtgatatcagggataggccggaggcctcgtgatgtgtcttcggattgttcatatcgggcatatagacatgtcgtaagcgctgatggcattgacgagatccatgatcggaagtcacgatggttatgcagtcatcatgcaaatgccattgatgttcgaatccataggcacttactgccaccaagccgccaaaaacccactgaggatgctcttgcgcaagagcgcgggccatatgcaacgttcgctccggcggcgtcaaaccatcccagtatgcggtatttgcataaagactgggaatgccgtcatacactttcaacaactcgccactctgggcacggcggcgtagagcggtctgttccgcttcatttcttgaatagacgcatctcagctcattctgcgcggctgatatgagcgaggccactgctttgtgtgtcttcatgacgtcgagcgtagccggaacgaagcagcgtaagtatgaatttcagccattgtggttctagcctcggagcttggctgtcttggagtgagatattcccgataatttcaaggtattaggccgctaattcggaatagtggataacatgcaaaacttatccaccatcagtaatgtcattcgaacaacgtgctttggggattcgaacaagatatcatcggcgaaggcggatgtagctggtagagggcggcgaattgacggttaacggtgcttatgctttgtacgccgtcggtgctggttcagatattggctggcttctgtctgagtgtggaatctagcgtcggcgtgagtccaatggttgtatcgtggccgacgatttgctgcgatttattggcggcatagatccagggcttggacggctgccgacggtgagagcagtcataacagtgaatgagcctctgcgagttcaaaagatgatgtagaggacgtttgtgagagtcgtttccggggcaagacatggtcgattgacgacgttgaaatttctcaacgacggcagaatggcatgccttggcgaggagacgacactgagaggcgatggagtcgggattaatccaggttttggccagccaccgactcgcaagagcatcatagcgtcggtgtaccgccagaagctggcactgtaccgacgctgaatagcatcagcgtcgccggacatacaagttttggattgcagccgactaagaatgggatgccgacggcaagagccgcattgcaactatatgagacggcttcactgtgcgtggctgcaggtagagactgcccgcgcggcggcgacatatgagacggtttcactgtgcgcgcacgataaaccaccccggcggctaggatagagggaattgagggagtgcggctccacgcgtgaaggcaagaatcccgaaccatgcagagcaaacctgtgcaaggggagcttcctgcgcatgcggaagcggaatatatgcgggcatgcgtagacatgacgagaatggcgcgaacacgtaagtggcatacgcactccgaacggcgcaacagcaacacgagcagaggttagaagaggatatgtcattcgagcatccgaatcggaacaatgagagcatgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgcgcctacggtatgcgcaccggcctgtacacgtcgccgcatctggagaagatcaacgagcgtatcgccatcgacggccagcagctgtccgatgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggatgcggccatcatcggcccggtggacatggaccacatgcagtggctgggcgacaccgtcgaacagatcgccaccgagaaggccggcatcatcaagccgaactgcaccgccatcatcggcccgcagccgcatgaggaagccgtcatgccgattctcgccgaagccgccgaacgcaaccacgccatgctcgtgcgcgacggctacgaaatgaccgcgtccgaccgtatggccgcagtcggcggccaagtcgccaccctgaccacgcccaacggcacttacgagggcgtgccgatcgccaagttcggcgagcatcaggcccacaacgcgcttgccgcgctcgccgcctccgaagtggtgattccggtcaacggcccgctggacggcgacttggtggccgaggcgttgagctcggtcaagattcccggacgcatcgaacagatccgcacctcaccgaccatcattctggatggcggacacaacgtgaatgccgccgaagccctgcgcaaggccatagaggaaagctacgacttcaagcagctggtcggcgtggtcgccatgatgcgcgacaagcaggtcgaggaatatctgggtgttctggagccgatcctgagctccgtggtggtcaccgagaactcgtggcgcgagcgtgtgatgccggccgatgagctcgagaagattgccgtggacgtgttcggccgtgaccgtgtgatcaaggaagcgaacctgcccgacgcgattcagactgccgtcaacatggtcgatgccgaggacgagctgggcgtgggctacggccacggcgtgcttatctgcggcagcttcgtcaccgccggcgacgcacgcctgatgcttgaggaacacgccagccccacgatgaggcaggccatggccgtccatcagccggcggtcgacccggacgattcggatcagccggcagacaaggccgaggatgaggccgccgacaacctcgaggattcggtgagcccggacgacttcgacgtgttcgacgtcctcggcctcggtaaggaacaggccagtgacgccggtaacgccggcaccggcacggccagtgccgacacaggcaccgacgattccgccgacgtccggtaacccgcatccaaggcacatcggatacccggacgcccgacatacggaaaacagtctcacgccatgtatctcaaggaactcaccctccgcggattcaaatccttcgcctccgccaccacgctgcgcttcgagcccggcatcacggcggtcgtcggccccaacggttcgggcaagtcgaacatcgtcgacgccctgacctgggtgatgggtgagcaaggtgccaaaaaccttcgcggcacttcgatggaggacgtgattttcgcgggcacgtcctcccgcccgccattgggccgtgcacaggtgagcctgaccatcgataattccgatcacacgctcgatatcgattacacggaagtcaccatatcccgcaccatcttccgcaacggcggctccgaatacgcgatcaacggctcgcaatgccgtctgctcgacattcaggaactcctctccgataccggtcttggccagcagatgcacgtgattgtgggtcagggacgattggatgcgattctgaaggccgacccgtccggccaccgtgcgttcatcgaagaggccgccggcatcctgaagcaccgcaagcgcaaggaacgcgcgttgcgcaagctggccaataccgaaacgaacctgagccgactcgacgatttgctgggggagattcaccgtcagctcggccccctcggacgccaggcacgcatctcccggcgcgccgacgcgattcagatatccgtacgcgacgcccaagcgcgcctgtatgccgaagacgcccaacgttcgatgagccgccgcgacacggtacgtcaagagcttggcgatgtgcgtaaccagctggccgtcgcccagcgtgaactcgcccaagtcaaagtacgcatcgaacaggtcgaggcgttgagctctgaatccagtccggccatcgccaaggccaaccaatactggcatgaattctcgcagacccgtgaacgactgaacgctctcgcccagttggccgaagagcgcagccggtcactcaccggccagatcgtcaccaatttcggtgaggatcccggcatactcgtcaaacgagccgaggaactggagtctcaggccgcggcacagaccaaggccgtggccgatgcgcgcatcgcactcgacaaggccaccgaggaacgcgccgacgacgagaagaagcttgcttcagtccgtcagaccttgacggaactgcgcaaaaccgcacaggagcgcgatgcgcaaatcgctcgattgcgcgaactcatcgcccgcgaggaatccgccgtgcaactggcgaccagccgcgccaaggattacgcctcccaacgtgactcgctgacttcccagcgcgacgatgcccggcaacagctggacgcattgcgcagcgaagcggactccattgccgacgatgacggtgccgcattggacgccgcacgtgcgacgctcgccgaatgccgcgaacgactgaacgaactcgccgataagcagcgcgagatacagtccaagatcatctcgctcaaagccaaggccgatgcgcttgccgacacgctagacagccgcaatgcttccggatcgttggagcgtgatacggacgtggcctcgcttggccgactcaccgacttcatccatgtggccgaaggctgggaagatgccgtggcccacgcgctcgaccagtatgccagcgccatcgtggtgcccgaggcaggcaacatgttgcacgccctcgaacgcgctcgggaagataagctcggcaaagccgtggtgctgaccgcgagcattgccggcgattccgccacagagccgggcacggagtcggaggagagtagcgccgagaacgcgggggacgccccgcaatcgggcaacgcgctggcagcactcgtcaccgcgaacccggatgccgagaacccggcacaggccgaagcggtcgtgcgcaccgtgcgtctcctgctggctgatgtagccgcggccggcaccgccgacgaagcccagcagattgtggcattcggcgaagccatgcgggccgtcagcaagaacggcgagacctttgcgcacggcgtggcggcggtcggcggctcttccatctctcaatcggacctgtctttggccgcacgccgagacaaagcattggcacaggtcaaacagttgaccgctcaagacggcggaatggctgagcaagtggccgaggccaaagccaaacgcgatgaagcggcccgactcgtcgatcaggaatccgccaaacgcaccgaagcccggctcaaagcccaacaggcggagaaatctctgaaatccgccacggatcgcatcgcatcgttcacccgtcagctcgaccagctggataggaaaatcaccgagacccaagagaatcgcaacgagcatcagcgcaagctcgacgatctcaatcgcgctttggcatcggcccggcaatccacagcggaacatgccgatttcgacgaactcgatgaacgcgaacgtacgctggagcgcggactgaacctgactcgcgagcatgaggtcgccgcgaaaatcgcgtggaccgaggcaagccgcaaaggggagtcactgagccgacaggccgggctgctgcgggacaacgccaaagaaaccgccgaacgccgcgcccgcatcgaggcgttgaacgatcgcagacgcgagcaggccgcgcacctgcaaggcgtggccgatgacgcgcgagcagtggccgccatggtagagcatacgctgcatgacgtggccgccaaacgagacgagctgcaggccgccgcctccagccatgacgaggaactcaaggccctgcgcgcgcagcgcaaccagatcgagcccaaggtcaccgatctgaccgggcgcgaacatgccttggatgtaaaccgcgaacggttggccgccgaatccgggcagctcatgcaaaaagtgtccgacgaactcggtctcactttggaggaattggttagtgattacggccccgaacagccggtgcccgtgctggatgatgagggcaaccctgtgccgttggatgagacggaagctgaggctgagaccgaagagggagaaaccgggggagagaccggcaccaacggcgattccgaccgctttaagaccgtgccgtataaccgtcaggagcagaagaagcgtctcgataaggctcgccgcgatctggccgcactcggcaagatcaaccctttggccaccgaggaattcgaagcgcttgaggagcggaacaagtatctcaatgatcagcgcaacgatgtggtcaaatcacgtgacgatttgatgcagctcatcaaggatctcgattccacgatggtccaggtattcaaatccgcgttcgacgataccgccgaggcattcgagcagatgttcgccacgctgttcccaggcggcaccgggcgactgcgcctggaaaacccggaagacatgctcaccaccggcgtactggtcgaggccagcccggccggcaagcgtgtcaaacagctgagcctcctgtccggcggcgaacgttcactgaccgcgctggcgttgctgttcgcgattttcaccgcccgccccagcccgttctatgtgatggacgaggtcgaggccgcgttggacgacgtgaacctgacccgtttgattaatgcgttcaatgagctacgcgcccatgcgcagctcatcattattactcaccagcaacgcaccatgtcgattgccgacgcgctctacggcgtaaccatgcgagccgacggcgtaacagccgtggtgagccaaaaactcgaacgataaatgaatggttcctgctggtaggaactggcgccacaggtgacagagggtggtccatctcgaaagaccaccctcagtttcgcttcgctcgacagctcccaccagcgggagcggggtggtattagcgtaatgccttgcgcacgccctgcacagtctgcagcgtcttgtagaagaccttcttgatgggtacgtcgcgggcgggggccaccggggtgatttcctcggtgaacttgcacttgaactcgttaagccccttgagcgacggcgcgaaatcggagccgatgcccatcagatcgtattccgtaataccctgcgagcccaggatgcagcattcggaatacagcagcttgtcggtcacatgcagacgcataacctcgttgcgcatgccggcatagtagcgcaccgcatgcgtgccgttcacggtgacaatcgaccatgccaccacacggtcttcaatacgtgcggcgaacacacggcaatgatcggcacccaacgcgccgatcatatcggagtagtcgctcatcggagcaggcgtgaatccatcgcgctggccggtttcgaccatcacatcgtaatattcggagaaatcggtcagggccttatccgtctcatcggcaacctcggccgggcattcacgtagagacttgcgcacgtcacggcgtccacgacgcttcatccgagccagaatctcatcatcgccaccggtgatgtcgatgaccacggtctggtcgtacggcactgtggacagcaccttctccgtaccatcggcgaaccaggtgtcgatacgcaggaacgcgatgctcttgtcggccttcttgacggtgtccacgatggcgtcgacgacctcgcgctcctcagcctcggtgggcttggcgacccacgccggcccatgcatcgagcgcagataatgataaccgtgcgtctcaaaatcgataaaggagatcacggcgaccaattcaccatcacgcttgatcagataattgccccatggtgtgcgtccgtcgatatccgcctgaaaaccagaccaaaccttggtctgttcgataggcaacgtgatgccggccttctcggcttcggcttccagtgtggctccgtcaactttctccaacgtgatcattacgattcagctatcctttttcgtttgtatccgtatgtcgtgtttctggtttggtcgtattgcgcgtgatctgatgtgggctaatcgggatccgatcaggatttgattggccggaatcccgtcacaagccaaacatgcgttcgacgacgtgatcgtcgccgtcgaacggcacatgcttgcgatggtccttgatccaacgctcgttgcccttgccgatgatcagcaggatgttgaatcggtcggcgtgcgcacgggcatcgtaaatggcgttggtgatggccgtcagacggtcggaaatcaccgtggagaccacatccttgttcgtgatgtagccttgcatttccatgcagatgtcgatgatcggctcggtgtccgtatcttcggcggtgaaaatgaagttcgcgatacggttctcggcagcctcgacgatttccttacgacgatcgtaggccttgttgccggccgatccggtcaccagcgtgatacgcgggttttcctcgccccaacgctcgtagacgaagtcaagcagcgcggtgacggatgcgtagttgtgcgcataatcgacgatggcgagcgtgtttgactgcgggtcgcggaactgttccatacggccggcgatacgtacggattcgatggcgtgcagtgcgtcggcgtcatcgagcgatacgccaaccgcatgggcgatggcgatggctgccgccgcattgaggtagttgaagtcgccatcgatggacagatggtagtcgccaagggcctgatctccgtcggcgatgtggaaggaggcgtgcgccgggtcggcgggccaggcgacgacgtccgcactggtgccggcattatccgcgtcatgcagggcgaaggtggtcacgccgatgccggctgcctccgcgtcctcccgcaacagatcggcgtgcagactgtccgcgccgagtaccagcgacttcgcgttgacgatgatctggcgcttgcaatacaggtaatcctcgaacgtggggtgttcgatcgggctgatgtggtcgggggagatgttgaggaacgcggccacatcgaaagtcaggccatagacgcggtccaccttgtacgcctgggaggagacctccatcaccagatacttcataccgttatcggccgcctcgcgcatcatgcggaaggcgtccatcgattcgggtgtggtcagatcggattcgacgtaggtgtggccgtcaaggcaattatcgaccgaggagaacaatgcggccttgccgccggagacggcgttgataagcgcctgcgtgaagtacgaggtggtcgtcttgcccttggtgccggtgacgccgatgaccgtgagctcgttctgcggatatccgtagaacgcggcggacagcaggctcatcgccttacgtgcgtcgttgacgatcaggccgggggtggcggttgcggctgagtactcggtttcggccacgtatgcggccaggccggcttcgtcgatgccgttcagatattcggccttgaactggcccttgcagcacagcagggtgcccggcgtgaccttgcgggtgtcgtaggtgatgccggcgaacggctcatccgccgaagcgatacgggccgggtcgtcggtccagacatccccttggatgatttcacgcagcagatggtgttccttgagcaggtcagcggccgaagccaaagtcaaagccataattgttactccctattatctagctgatacgccattctacaggtggggtgcagcgtgttgtggctccccggattcaacttgtaagtgcaacggctggtttcgggtcggcttgttttgatttacgaaaccaacggctcgacgacgaaccgacatccacgaaaacagcaatagcgcctcttttatcgaggtaacatattccctctttatgcattcatacccccctatttgaaagctctgccaaatatcgccgacgctgcgacttatcatgttgccatactttgcaatcctttgcatccccttgcatctcaacggcttgtccgaagtaagccgcatcactgacagccgtagcaacgttgttcgtatcgcattttcagacttcttatgccccctacattgcccctatatggccccgtcggcatgttgcatgaaaggcttggtgcggagtaacgtttcgcagtgtggcgcgtgcggtgttgccatttgcgacagcacctatgccatgcacgactaagacggacccggccgtcttgtataagcaaatcatgagcagatcaagcgaaggaacaggcgactatggcattgctgcatcgacgttcgacgagtaagcgtgcctcacagaaaatgtgggaaaacaacgcggccatgccggatgacgcatctgcaaatgacaacgtttcctcagcgcggcccgagcccgcagcattcgttccaacaccatttgacgaagtcatcgatatcagcgatctcgtggccgagcgccgacgcctgcaacgcaacctgtgggcgatgcgcatcatcaccattgtgctgctgatcgccgcaatcgccgtggcctgcttcccgctagcgttgcaattcgagtccgaccgcaacttggccgccaccacagccaccacggccaaagaagtagctggctggccttacccgcaggcggaagacaagctcacggcggcccgcgcatacaacaagaagctcgctgaatccggccagcctatcttgggtgaagccgtcgatccgttcgccgccgctcaaggaggatcccaagccagcggcgaggattccgcctcaaagaaagacaaggaataccagtcactgcttaataccggcaacggcgtgatgggcacaatcaaggtgcccaagcagtccatcaatctgccgttttatcacggcacttccgaggaagcactggcttctggtgccggccacttgtacggcacgtcgctgccggtgggaggtaaatccacccattcggtcattaccgggcaccgcgggttggttgaagcgctgatgttcacccgtttggacgaggtgaaagagggcgacttcttctacatcgaagtcatgggcgaaactttgggctacaaagtggaccgcatttcggtgattttgccggatgacacgtcgaagctcaagatcgtgccgggtgaggatcgcgtcactttgatgacctgtacgccatacggcgtgaacacgcaccgactgcttatctccgggcaccgcgtggcgattccgatgccggcccccgagccgaatgacgtgcttgacgcgcgcaatatcgcccttggtgttggtctaggcatactggcggcaggactgttcattatctggttggcacgacgccacaaggccgcgcgcatcatccgccacggcgcattctggccgtggatgcgccgcaagggcgaaagcgccaatgatacgctggcttaggcctcgcgccgaccggccagtgccctgcccagcgtgatttcgtcggcatactccaagtcggagcccaccggcaggccgctggcaagtcgggtgaccttgacacctacgggtcgcaatagctgggtcaagtagctggtggtggcctcgccttcaatattcgggtcgagcgccataatcacttccttgacctcatcgccttctaagcgtttgagcagaccgggaatacgcaggtcggcagggccaacgttggccattgggttgattgcgccgccgagcacatggtataggccgtggtattcgcgcgtgcgctcgatgctcatcacatccttgggctcttcgaccacgcagatcaccgaacggtcgcgtctcgggtcggcgcataccgggcaggggctggattcgcacacgttgccgcaaatatcacagaagcggatcttggccttgacctcttcgatggcctcggccaaatcgcgcgcttcatcttcgggcgcggacagcatgtagaaggcgatacgctgcgcgcccttcggcccgatgccgggcagccgcccgaaagcgtcgatcagtcgttgtattgcgccgtcataagcaagtgccatgggtattcctcgttattcgtcctcattattcatccgagtgcttcttggcaggctggatgttcttggggttcttcggatcatctgccgcgaattgctcgacttttttgacctcgaatagctttttcagatcgtcgagattcatggccgtcgcctcgccgagcgactggtcgctcatcgagtattcgtcatcctcggccgcgacttgcggttgtggtttcggctggggctggggctggctattccacgggtcggcattcggggtcggctgtgcgggttgcggttgattccacgggtcaccgtgcggggtggcctgcggagccgattgtggaactgcctgcggttgattccacgggtcatcgccggcagccggctgcggaaccgattggggctggttccacgggtcatcgcccgacatattgcccgacactgtctgaggaaccgaagaagccggagtctgggactgaggctgattccacgggtcgtctcctggctgcggagccgcctgagcatggttcccctgcggttgattccacggatcatcgtgaggagactgctgatatggctggttccacgggtcggcttcggccggttgcgacgccggtgagaccgcggcctgagactgcgtctgattccatggatcgtcgctcgcgccggcaactgccgtaacggaagatgcggtggctggctgcccagtggactgtccagtgggtccagcggacgcaacggacgcagtgggtgcaacaggagcagccggagcggcccacggatcaacaccgtcactgatgtccggaaccgcaacatgcttcttgtgatgctcttcgggcgcaggcgtagcagcgggctcgttaggtgcgaacccgtctgcagattgcggcgaagcgttgcttacggccggcttggcccaagggtcatcgtcactccagttcttcgccgccgtggatgcactggattggccggctcgatggctgtcgtccgtatcctcggctcggcctgttgcagtcggcttcggagctttcggctcgctccccatatgaatgcccaggcccgcgcccaaactcgacgcggccaatccagccttggccatggcaatctgctgcttgaccttggccaattgctccgggctcatacgtttgacggattcgactcgctcgccattcgccgcgaccgcagaaggtgcaataaccgcattggcaccgaactcgttgcgcacggcatccatcaccacgaccgccgccttcttaccgctgttatccacggccaaggcgaaagcgtgctggctcagcgacttgtcgaacgtcatcgacaggcaaggcagacccttacggttgggaccgaattttacggtcggcaccttgtctcgtgacacatattcacgaatggtttccggcaaagcggcgacggctgcatcccacttctcgtcgatggaccgattatccgatgccgcaggcgaggtcaccggttgagccgggacggccggcgacgcggcgggagcgccccacccggcaccggcagcagcagttgctacagcaggttgcacagacggagagtccgcaggtcggtcgctgaccgggccgttgcctccaacagattcatgggaagcggtgctctgaggcgcggctgcttgctggttgcgtgcagcaccggagaatccgccatgtgaggctccggcaaacccgccccgcgatgcgccggcaaaaccactggcacccgtaccggaagcggctgacgtagtcgaagccgaagaagcagccgcaggcggcataccagaagaagctggcgcgggagcggctgttgcaaagcctgattcactgccggccaacaatcgcgcggccagcagttccaagcgcatacgcggagaaatggctccggtcatggcacccaacgtagtgttgatgatgtctgccattgcggtcagtgcgcccagtcccagcgccttggcttggcggtgcagatcgtccatatcctcggcctcagccgtgtcggacagcacggattccgcacggtccccggccaacgtaagcaccagcagatcacgcacacgagccagtaggtcttcgacgaatcgtctcggatcgaatccgccgaccacgactttctggataacgccgtacagggcttcgccgttgtgatcgattaccgcatccacggcctcaccgatcagtgcctccggcgtgaagccgagcagggctacagcggcatcatgggtgataacgccttcgaccgaaccaaccatcagctggtcaagcacggacagggtatctcgcatggagccgccaccggcgcgcatcgccagtttcagcacaccgggctcgggcttgatgccttccttgtcgcagatcgtctccaggtagggacccatgacttcctgcggcaccagacggaacggatagtggtgggtgcgcgaacggatggtgccaatcaccttgtctggttcggtggtggcgaagatgaacatcacatgttcaggcggctcttcaacgattttaagcagcgcattgaagccctgctgcgtgaccatgtgggcctcatcgagaatgaaaatcttatagcggtcgcgcgcaggggcgaacccagcgcgttctcgcaattctcgagcatcatccacaccgttgtgcgaggccgcatcgatttcgaccacgtcgatggaacccggaccgccggtggccaggtccttgcagctttcgcattcgccgcaggggtgggaagtcggccctttggcacagttgacgcaacgggccaggatacgcgcggagctggttttgccgcagcctcgcggccctgagaacagataggcatgtgtgagcttgccctcgtccaaggcgcgcatcagcgggaccgtgacttggtcctggccgatgaccccttcgaaggtgtccggacgatagcgacgatacagtgcaagtgccatagctactaacctacctttgccctcagaattaaccgataaaaagtcaagataaaccgggctcatagttgccgaatcgggaaaactctttatattccaacgacattcacctgacaacggttaccgcatttttattgttattaaccgctttctttgtattaacatagtgtcaataacggttgtggtcaggaggcacccatgagcgatatcctcgacgagaaacgccccacccgcggcgatgcccggcgcgacgccatcgtgcaagccgcgcgcaaggtgtgtctggaaaaaggcttctccaaaatcaccgtttccgacatcgcaagcgaagtcggtatgacgcgttcgctgttctaccactacttcgaagacaaggaagccgtagctgacgcagtactcgataacgtcatcgacgaaatcctcaccacgttgaagcagtggaaccaagcgcgcgaaacaggcaacgtgaacaaggcattagacgacatcgtgcatgtactccgctccctgatcgccgacgagagccccttctcaaaccgtatgatccaagacggcaacgccgaactgtatatcaagttcattgaccgcgcggcggaccgtattgccgactacattgcccagaccaccgtacgtgatttcgagcagatgcatggcctgccaatcaccaacgtccatgagacgttcttcacactgattgtggggcttatctcactgattcgctcgcatccgaacatcagcgaccgaaccatcaaagaggtcatggcgcagacgctgcatatcgaaagctatgtcgtctgaggtctgacgggcattggctctggtaccgctctcccgcactcccctcagtccgcttcgcggccagctcgtccgcaattgcggacagcctacggctgactttcttctggttcgactatcgtcgaaccctcgcctacaaacagcccactgggctgtttgctttacagctcagcctaatgaggggagccaatataatcgggtcacgcgaactggccggtcacgggatcgcgaccatctcgggcaatgacgtcgagcacttcctgtcgggaatccacctcacgggcggctacggccggcggcactagcacgcgcaacgcgcagtcctcggccactaccctaaatggcaaatgcccgatatattcgccgtccgccatcagcaccggtggctcgtctccttccgctgcccgcgtgacttcgatttcacggatacgtttccagccgaacacctttgaagcaagtagcttgccgttataggcattcgaaatggccaccgcgcattcgccgaagttcggcacgtggtccatccacaccaggtccaacaatccatcggagaagcaggagtacggcgagacctcaatgccgccaccgatatgcctcgaattcgcaatcgtcagcaatggtgtgatgatgtctcgttcatccgtggtaccgtccgccaatgtggctttgatgtggtaaccataacgcttcatatgcgtcagctccaccagcaccgccgcaaagtagcgcatggtgccggtcggcagatgcgaatgattcgcacggtcgttgatgctcgcgtcaagaccacaggacagcatgcccgcatagtaccggtcaatcggatgctcggcggacttgctctcctggtactcgtactcctcgccagtggagggatccacggcatagccgccgtccaaagaggtcacgcgtcccatgtccacatcgatgtgtgatccgcgcacgatagcaccgacgataccttccactgcggtttcgatacggttgaccggcagcttcagtcctcgtgcgaaatcgttgcccgaccccgtggccacgatgcccaacggcttgccactgcagcccacggcgttcgctccaagtgcgatcatgccgtcgccaccgaccactacgagatagtcgtactcgtgcgcgcgttcacgcgcctggttcagggaatcgtcgaaacttacgccggtgatgtcgatgacgtcgaagttatgggcacggccggcttcctccagcagacccaatacctgcgcgtccaccttagcgccacggcctttatcggaagtggggttgcccaccatggccaccacgcgacggcgctcgttgcgttcactctcgctcatgctctcaccttagccaaaggcccagaagcccgccagagtatcggtgctttacggtccattattgtgataattgtctccttccgtacaactcaccggtccggcccgagccatccgctccacggatgatgccaccaggaccatggtttccaccttgatggttaccaacacgtcttcatcccgcacggagcaggagcccaaaactacaccattcgcttcagccatgttggcggcgagcgcacatggatcaccgatatccgcatgccacagcgcatacgcggcgtcaaaggcgataaggtcggcgagggaacgcgctcggttctggcagatcatgaggctgcccacacttgccgccaccgcgagcgcaatgcccaccaccataaccagcatggctccggccatcgtgcccgatccctcctcataacgcattccctgcaccgcagttcctttctgttgcggccgcccagccagccgaccgttattggcttatcgccgtagcgttgccggtaacccgcgttggagtgacatccagcggaccaggcaataccgaacattcgaccatcacactcgtcgattggccgtcgtgggcaatgatgacgcgaggctctcccccggcaacgtccgcagctatgctgcgcgaggatgattcgtcaccggtaaccacaaactcgcgtgcagccgctgccgcggcactttgacagtccatggaaacgatgaccacacgtcctattgccaatatcagcccggcgatggcgataacgctgggcaatacaatcgcgaattcggcggtggccgaccccgtgcataggtctggcggcagtctggcgagccgccaccggcatgtcatggtcttcatggctgtcacccgactttcagagcctgtttgatgatgttggtcagcaacgtcttgatggcatccgacttcaggatggcgaccagcaccgccgcaaagcctgtagccgcaacgagtacgactgcgtattccgcagtggccgcgccttcttcgggctcagccatgagggtgcggatgcgtgcgtccatgaggcatagccgttctttcgccttggcgttcagcgtggccacacgagccttgctgtgcgcaaagatgccggcctgcccgtcgacgatgacggggataggggtattcattggcgttcctttcggtaaggagggaagctgcgcagtggcttcgcaccttccccatgcgtgtgtgagtggttggcccccgcgccgggttgacgcggggtgcataccactgtggactatcaacgcttcatgcaccaggaaaaacggggtatgtggttctagcttgccgagttatccacaccccgacgtgtcgtccaccaccaatgtggataaccaaacgcagccaagtgcaataccgagcgatacaacaagattcagcccaagcgcactcggttcacgcctatattcacatcatgaaggacgcaatcgccggaatgactcctaccagcacgaatgccggcagaaaacatagccctgtaggcatcagtagctttaccgacagcttcgcggcattccgttcgatggcggcacgctcgtcacggtccagctgttcaatggcggattcgaggcgcacgccaggcatatcgccatgcgtccatgacgattccaaagccgattgcagcaggccaagatctcgttgcgttctgctggtacgttttccggatgaactatcagctggcgcaccctcatgctgaacagccatagcggcatgccacgcatcagcccagggaacccctctggccagggagctcccgacctcgctcatgcgagcgccgcagtcgccgccgacggctttgcccaccatgtcaagcgcccggggaatcgaggagccctgacgcaaggacacctgcaacatacgcaatatgagtatggtccatgacgacccgcaatcatgcgctacggccggttcctcgcccggcaagcggctgtcatgacgagacggagccttatacagccaactagcgatcgccgcacagcctgccgcggcgtgtacccacaccgtactcataatccgctgcctttcaacaatgcccgcatccatgccaagccggcagcataacaacatccccctaataccaagcagaccacaccgcgtggcgatccaagcaagaacgccaatggtctagctcccagaagctcgcccaatgccacagtgacggccggaagcgcgctcagcagccccacagtggctttaggaacggcacatgcttgcgatcgcaggttctgcatcagcctcatctgccggtaagcagtcaataccgcttccagacatggcactgcttggcaaccgagctcatcgctcaaaaccgctgcggcggtgaccccgcgtgcagcttcaagtacctgcgctggtgattcgtcgggcagacgccgctgttcgaacaccgttatgagccgttccacagtaatgcgctgagtggcgaagcgtctgctggattgttcctcgaatgcttcaaccaatgtgccgccacctcgcaatcgcgcgatggcggacgtaatcacctgcgcaacgcccacgcgaggtgagccggcatatcgaggttcgtttatggctgcggaatcgaccgcacgcccgcggtaagccagccgatacagcctcccggacttgttccccggccatatcagcacggcgagcgccaccagaacagcacaccacatcatcacccaccaccactcggcccgggaacgatgccccatcgttcaatgaagtgcccccattcggcggcataccgaggaggatggcagccattccataccgccagcggtgttcctgccagttcaccatgtgctacacgcagttcgccgatctgcgtgatacgccgctgtccgttcactcgctccaaatgcaccaccgcgtcgaaagcgcctgccgccagcatggccaacgcctgtggactgactccggcgagtaatccaagcgaaatcagcctggacggtactcggttcacgccgtccgcatgcacagtggtcatgccaccgtgatgaccagaattgaacgcgcgcaataggtcgacgatttccgcgccacggcattcgcccagcaccacgcggtcggggcgcattcgcaacgtcgctttgaccaagtccgtcagacttatggctccgacgccctccacattcgcctcgcgcgttaccaacgacacatgatcgccacgccccagttctcccagttcacgaacttcctctacggtgacgatgcgctcgttcacatcgcattgcgccagcagcgccttgagcaaggtggtcttgcccacgcctgttccgccggtaatcagcactgtggcatgtctgcgcaccagtcccacgaacatcggcagccaagcagccgggaatacacctaattggctcagatgtcgcaacgatgccatggtcctgtcagggaaccgtatggagattgcggcaccttgtggcaccaatggggcaatcaccgcatgcacgcggatgccgtctggactggcggcgtccgctatcgggcaggcatcatccagtctgcgcccaagctgcgcgcacagttggacggcgtattctcgaactacttgcggcgagcgaaacggcacacgcaatactgtttctcgcatgccgttgccgcggtccgcccaaacgcggccatcacaggtcaccgccagatcggtaacctgcgggtcggatgccacatcattcaatagaccgaagaacacagttctgggcactgcgccgggctcatcagcccgagtgattacggcagccataccgcatcaccggtccttgcaagaagctcccgaaaccgggcgaatggcctgctcgacaagatcggcaagcaagctcacggctttgcggctgcctttggtcaccgatctgatgccgaggccttccagtacgtctccacacagattgacacttggtttgacaggccccaataccgtggcagtcaaatagtcctgcgcctcaccaatacccacgtggcctctcccacgtggagcgccacgtggttccacgccgacgatatgtggcgcttcacagccccatgaatccagtctggaccggtgcgacttggctctggccagccccatcaccgacaattccgcggcaatcacctgcatgccactgcgcagatcgggtacggtctcaatgagtccaccctgaccggcatctacgatgacaacgtcgttcgtttccgccaaggctcgaatggccgcttgaacttcccaccagtcaggctggcgcgcgctccaagggtcatagggaagtactcgcacaccctcccacatcatcagctcatggttcatcgcatcgccctcgatgcggccgaggggtgcgtcgacttggctgaatcgtaaacccggctctcgttctacacccagcagcaggtcaaggcatccggccacgaaatcagcgtctatgagagcgcagctgtgttcacgtctcgccaatgtccatgcaagcatggaagccatgacactcaaccccacgcctccatgacctgacgtcatcgtcacaatgttatggaagctggtgtctgtagttagggcgagtgccggagcctcgcccgatctctgccgttcgcatgaggccaacggcctgggcggcggagtgtagtagcgatgcgctggaatcggcgcatcgtccgtgggcagcggaatgcccggaggtgctaccgctggcgaggtgatcctacgcgccacgcggggtgtggtgttgctattcataagccgattgaaacgtgtccgagttcaatgctcaacacgaatcgaccattgtggttctagcttgctgagttatccacaccccggcatgtcgtccacgacaaatgtggataaccacgctgttgtttcacgcccatctcatgcagaaaaggccctgacctcatatgcacagtcagggccttcattttcacgacgattccttatgcggtaatctacattccttgcttacttatcgaggttcttgatgccgtcttccatgacgtccaactgagcatcggtcaccttggccggcttcttcttgccgaacttggccttgagcagaccgatgatggtcggggcgagcgaaaccagcagaatcagcacgatcaccagttcgaagtgatcctgcacggccggaatgttgccgaagaagtagcccagcagcgtgaacaacgtggaccagcacaggccgccgagcactgagaacggcgtgaaacggctccaacgcataccggaaataccggaaatgaacggcatgaacgtacgaatgaacgggaagaagcggcccaggaacacagccagcgggccccacttttcaatcatgccctcggttttggccagtcgctcaggagtcagcgccttcaccttgccggattggataatacggcggccaaagaaatgaccgatgaagtagttgcactggtcgccgataatcggcgcgcaccaaaccaccggcagcaaccagaacagcggcagcgcggccttgccggtcgcagcatccggggctgcgaacacgccggccgcgaacaacagcgaatcaccgggcaggaacgggaagaacaccacgcccgtttcgatgaatacgatgaggaagatgaatccgagggtcggcgccacgcccatggcaatccaaccggcaatcgcggcacgcggatccttcagcagttcgatgatgaaattaacgaagcccatgtgtttcctatgagtcctaaatcttgtattgagctgccagcccaatgaaccagacagttatatgcaaaccgtcaaataccctaccagccggcctataacatcaggtcgactggggtttcccacacaaactccgcaatacaaacgaaatttctactcccccaaacgctgccgcacaaaggcgtccagcgcggccgcatcgatgccctcatacgagtcgatggaggcaaactggccaaggccggaagtgtcggtgcgaatccagccagtctgcgcaatcagtgtgccccccgaggcggcgccggagcgcagaccggatgaggaatcttccattaccacgcacttgaccatgtcttcaggcgcgatgccgagtctctcagccgcggccagatatggggcagggctcggcttgtgctcgtacggatcatcgccgcagacgtagccggcaagcaatccatcagcctgcttcatgatgttctcggccatgcggcgaggcgaagtagtgaccagcatggatgggatgtcggcttccttgagcgaatgcagcacgtcttgcacaccaggaatccacggcagacgttcgacctccgccttgaacacataatccttgagctgcttgtcgatttcgggaacgctcaatgtgcagccatgcgcaatcatgacctctgccacgtgtggtaccggagtgccggagcactcccaaccgaggtcctcgttccactcgccgccattgttgtgcgcgatctcaatctcaccgtcatgccagagcggctcagaatcgatgagagtaccgtccaaatcccagaacacggctttgagcagcatagttacctccgtccacatgcccgcacgccaattggcgcctttactcttgctgcattccattgcaccaatcggatgcgacaaccatagcgcgtcagcacaccgcccctgcgcctcagcgcatggtcagcccaccatcgacgtgcagacattgtccggtaatgaagccggccatgtcggacgccaacaacgcgacccctccggcgatgtcatcgggacgggcaaggcggccaagaggcgtcatggcaatgattcgttcacgaacatcctcggtggtggctgcgctggatgcggttccggccgtcaaacctgcggcaatggcattaacggtaatgccgaagccgcccagctcctgggccagagagcgggtcatgccgaccaagccgcctttggcagtgatatacgaatggtagggcacgatgggcgaatcgaccagattgctggagatgttgatgatacgcccggaggtctgggctcgcatcagcggcaccacatgtgagcacatcagatatgcaccatgcaggcatccctcgatctgtgcgctaaactcatcccaatcgcctccagcaaaagtggaacggcgacgcgggtcaaaggagaagcgtccgaaagcattattcactaagatgtccacgccgccgaatgagtcgacagcggtacccactagcttggaagattgcgattcatcgcaaacatccgcctgtacagctatagccaagcctcccagcgagtggatgtcttcaacggtgcgctgcgcgctggcggcgtcatgtacgtaattgatgacgacagcggctccgtgcgatgccaggcatttcgccacagccgctcctatgcccttgccggaaccggtgatgatcgctgttctgccatccagattcaccattggacgccgtgccatatcgctttgctctgtcattacccttgcctttcgccctgctaccagcctctgctgcccgcaacagcacaggcctattccatatccatatcgaacgaatcgctgtacgcgtcgctgccgcgttcgacatccaccgcgcgcaacagatcgatgaggttgaagcccccatcatgatgccagccggatttcgcccgatccatctcaccgagcggacagatgcgattcacaccgacctcggccaatgtatctgcaagaccaaacagtctggttgaatccacagcgacaccgcagctttgcagccagccacggcaggaagtcagtcttctggcagcgtccaacaaatctggcaccgccaccacgttgacggtgcggttcaacggcgacatcagcgaagcaacatcctcgtcggcaccgctaccgtcaagttctcgatacagcaccgaccatgccgtgctatggccactggcgaacaccgcggccttcccgcccatcaaggctctcatctcagcgtcggtgcgcgcccgctgaatggccacgttctcggcgtcactcaatacggagcgcggatatttgcgctgctgattctcaagctcgccaccgagcagctgagccacttcacgaggggtgagggctccatcagtctccacgaacacggtctgcggagccaggcagctttgctggtcatatgtggcgatgtcaacagccacacgatgcacggtatcggcataggtatcaggacgcaaagcctctcggccaatgaacgccaacccgacttttgctccgtaacctagacagggcttggacccggcgactttgcccgcaatcaatttggtagtctgcgaagaaccgtaaacaatcacggcatcggccgcatcgatggctgaatcctcgagctgctgcgagccgcccttccatggaaccaccgcaatggcatcagcgaggtcggaattgaccatcgcaatgctgcgagcaaagaacgcaggcatcaccggctcggaaaatgaagatttgccaagaatcgcgcctttgaccagcagggtcatcgccatgctccacacgggaatccccggcacattgctggagaacacctgataggtgagcgctgggcccacatatttagagtatccccccgccttgttcggccggaattcgtcgagcatagacggctgaccgatttcggagtcaaggaaccggagcagttcacgacgcctgaactggcgcatataccgtttgagctcaatccgcaccatgtcaggctcatatccggtgattgcgggaatcagcagttcagcctgacgccgcagctcaaaatccggatcggcccatagttgggccgcgtcggccacgatgtcgagaatatcgttgacactcatcgcggcaagcgtgcggttgcgaacatcgacaagctgcttggcaagggaagtcacctttgagccatccagtcgcggatagcgcaaacgcttcaccccatccgatgtggcgacctcatagatttcgtaatccgaaacatccactcccgagggcaggtggaagacatcaatggcctgactcacggattcatcaacggttggcactgatgacctcgtctaccgcgattgagcacccacgagcctcggctcccttcgccctgccctgcagcaggaatccgtccggggtccgatggccgaggtcctcggtcagaataccgatgcatgaattccaattggcaaggtcgtaatgggctatcacaccggtctcaccatccttgacgggagtcagcgtttccggatcgaggaagaccgtgcgcacccaggcggggttcgccttgagatagttgctggtgccatccgtataccacgacagaatattttggtcatagatctgcgagctcaactcggtcatgccatacatgttgacgcagtggtggcgcggcacccccagtgtctgttccagctcatcaagcatctggtcttcggtgatgtcgcgcttagtgctcttgaagccgccagtgtcgaacaaccggctatcgggggccagcgcgaacgtcagatcatgctcatgcaggtaatcgaacagatacagataggacgacgagacacccatcagcatcaccggttcaccgtcagacaccgcacggttaaggaaggcgatgatttcatcgaacttgagtccatgctcgtcgaagaacacaccgctgccttcgctgccgcagcactccacggccttggtaaggtagcgcgacagggaggagttctggttcatgtcccatgccggcgaaatcacggcgatgcggatacgctctcgatccggcatgatgaaatgacggaacggcacaatcattgattcatcccacacctcaagatcgggatggaagttgcgcccacgcatcttgccgccatgcgtggttccgctcgtcatgaatacggcttcgcactgctcggtcggtatggtcgaaaggtcaaggtgcttgaacccgtccaccggcatcggcggaatctcccgccaatccttgagcgttgcgggggtgacgcgtttagccgcgcagtaacgacggtacggcagatcatacgtgtactgatagatgaacacgtcgcgcgccaacgcaccaaacgcctcttccggggcctgctcacagccataggtatggataaaatccagaatcccgcgcttgatacgacgcgcgtcatccatcacatcagtcattgcatcgctcctgtcaatatccaatatcaaccagcattatcgttcatcgtacgccgcagcgccagtcccatccgccggatcggctgctggaacatccacggacgccggcgcacgatgcttcgccaccaaatccggaagagcgacgaaaagcgcattgagaatgatggcgctgaatacaccgaccatgatgttgttgccaaagaacacgcttgcgccgccggtcaggccggagagcgccttgggcagggcgatgccgagcaacagagacatgccgatgaccgtttgacggcgctcgtcatcagcgaccttgcgcagggcgcgcaggccggtcacgattaggctggccgcagccggcaggaaaatgcctccgacgactgccgagggaatgacggacagcaacgcgcccgcctttggcacgaagcccagaatcagcaacagcacagcggcgatgatcacaggcgtgcgcgtgcgcaacttgccttcgccggtcaggttgagcaggccgacattttgcgggtaggcggtggtggtgaatccaccaatcagcgaggaaatggctgaaccggccgcctcgccggcaagaccgtagcgcacctgcttgcgttcgagggacgtgccctgaatctcagaagccgcctgatagacgccgagagcttccatgacggcaaccatgtaggcaatgaagaacgggatgaagatcttccagtcaaatgtgaacggaccgtagggcaggaaggtcggcaggcccaaccatcccttggatgccacaggagagaagtccaccatgccaaacgctgcggcgaccacggtgccgacgacgagcgcgatgaggaatgagaacgacttgagcaggcccttgccgagcaacgacaggacaagcacaatcgccgtggtcagaatcgacacggtcaggatgtgcggatcggcgaacgtcttgtcgccgggagccccgcctagaaactcgctcagcgtgaatccagacagcgagacaccgaccataaagatgaccacgcccgaaatcatcggagagaacaggaaccgcatccgctctatcacaccggtcaggcacagcaacaggaacacaagcgaagcgatgagaatggacgaactcgccgcccccagcatgccggccgtacctgccgcgatcatcaacgcgtcaaacgcggctgacggcccctgcaccaccggcaggcgaaccagccgagtggcctgaaccaaagtaaccagaccagagacgatgaagatggcgttaatcatgttcgacgacagggcaataggtaagccgattgctccggccacaaacaccggatcaagccagacgttggaaacaagcacatgctggaaacccagcagtacgttctgggcggtcagctccttgcgtattgacatacgcttcctctctctcaacgcgcatatgggatgccgagccgaacagaggagttcaaccgtcgcattccctacgcgagtgttagctcacaggttcgaagggttcggcacataccgtctcagcctaaagcaccccttacgaatcggttttcgcacgtcaccgtaacaaaccttgacatctccgtcaagaagattcgtgcttttcggcagctgcccgatgtgagataacaaacagttttacgaatggagaaggaatcgaagcaatgcggccagactcaccaaccccacaggaccatggacttggagtcggcgggagtgtagttggagtcgccggtggcgccggcagcgatatcggcggcagtatcgcggccgggcagttcgcgggtttcgcggcggatggcgttgcgccagaggcgggcgcggttggagcgttgtatctccacgatattgccgtcacgacctgcggcgaaaacgctctcctggtcgccggtttgcatgcgtttgacttcgcggcgcagttggcgattctcttcttcgaggaccaaaatgcgcgcgataccggaaaggttgatgccctcatcctggctcaggcgctgagctcgggtcaggcgggcaatgtcgcgcaggcagtagcggcgtgcgccgccatcggtgcgctgcggacgaaccaaaccgaggcggtcgtactgacggagggtctgggggtgaatgttggccaactcggcggtctggccgacggtgaagatgggcagttcgatgtcgaagccgacgtcatcggctccgtcgagatcggccctgcccatcacgagcgcggttgcgcacatcgcgtataactgcttcatctggttggctaaccgcgccattgttcacctcctgattacaggctgagatagtcgccggctttttcgtcgaattctttggcggcgtgcttgacggccagacccggcttggcggggaccatgatctgcacacggccgatcagatcgcccggctggttgctgcgctggacgccaagtcccgcgagcttgacttccgcgccggagctggagcctgccggcaccttgaaggtaacgggattgccgtcgatatccttggcctcgaccttgccaccggccacggcctggcccacggtgacgggcaggtccatgacgatatcatggccgcgcatcgagaatgtggcatcgggcttgacggtgacgtgcaggtacaggtcaccggccttgccgccgttgatgcctggcttgcccttgccggccagcttgattttctgtccgtccttgacgcccgcaggcacgtgggccttgaacttcttgccgtccacggacagggacacggtagcgcccttgaccgcctgacgcagggtcaggctgatcttggagttgcggtcctcgccgttttcggggcgcggggcctcctcatagccatagccgccggcattgccgtacggcgattggccgtagccgccatacggctggccgccctgacctgcagcaccgccgaacatcgagaagatgtcgttgatgttgttggggccgccgcccgaagtggagaagcggatgcgcgagccattgccgccggcaccctggccgaacatggaaccaaagatgtcggagaaaccggaagcatcgaagccgccggaaccgccggcgaagcgggcaccgcccatgccgaactgacgaatcgcgtcgtacttctggcgatcttccttcttgctcagcacgtcataggcttcggagatgtccttgaacttctcctcggcttccttggtcttgttgacgtcaggatggtatttgcgggcgagcttgcggtacgccttcttgatgtcgtcgtccgaagcgtccttggagacaccaaggactttgtagaagtctttgctgagccattcgttttcagccattcatgtctcctttctagaaaagtctttatgtaattgcacctccctctgatgagggaggtggcatcgcgcagcgatgacggagggaaagatagcggggactatgggcatcaagaatgtggccctctgtcttccgcggcctgcggccggcttctctccctcagtcagcttcgctgacagctccctcatcagagggagctaaggcactgtcaactcattgcagcgagctggatgtcagttttgcggggaggctactactactcgggcggcgcggattacgcgatcgccgatgcggtagccggcctcgaccacggtgtcaaccgtttccttttcggcatccgcgtccggcttgtgcaggatcgcgtcatgcttggtggggtcgaagtcctcgcccttttcgccgaacttctcgacaccgaacttctcgaaggccttgtcaatcttggtggcgacggccttgaacgagtcgtccatctcgctgtgttcgcgaatgcggtcgatatcgtcgagggcgggcagcagcgcggtcagcacgtcgatgatgccgtgctggcggaagcgctcctgctccttctgcgtgcgattgcggtagttgatgaactccgcacgttcgcgttgcagggcttcgaggtagtctgcggcttccttcttggccttgccgagcggggtgagggtgtctgcggaatcggactggccttcgccagtcttctctccctcagctgcggcaggagccgcgtcggctccttcattggaaggagcctgggcagccgaatcctgcgcagagccggactcggcggaggcgtcagcccctgaagaggcctgagcggtagcctcagcatctgagggatccggcaggtcgttcaggtagtcgtccttgttgaactcggacatcacttgttgtccttgtcgtcatcgtcgtccacgacctcggcctcgacggtgtcgtcgtcggaaccggaggcggagccagcggaagcgccggcaccgtcagcaccagcggcagcaccctcggcaccctgctgggcgtagaggacctggccgatcttctgggcggcggtcatcagctcggtctgagcggtcttgaccttctcggtgtcgtcacccttcagggcttccttcagagcgttgaccttgtcggtgacttccttgacgatgtcgtcggagagcttgtccttgttgtcgttgacgagcttctcggtggagtaggcgaaggcctcggcctggttgcgggtctcggcgtcttccttgcgcttcttgtcctcagcctcatgagcttcggcttccttgaccatgcggtcgatctcgtccttcggcaggccggaaccaccggtgatggtcatggactgctccttgccggtgcccttgtccttagcggacacgtgcacgatgccgttggcgtcgatgtcgaaggtgacctcgatctgcgggacgccacgcggagccggagcgatgccggtcagctcgaaggtgcccagcggcttgttgtcgcgagcgaactcacgctcaccctggtagacctgaatcagcacggacggctggttgtcttcagcggtggagaagacctcggagcgcttggtcgggatggcggtgttgcgatcgatgagcttggtcatgatgccacccttggtctcgataccgagggacagcggggtcacgtcgataagcaggacgtccttacggtcgcccttgatgacgccggactgcacggcggcaccgacagccacaacctcatccgggttcacggactggttcgcttccttaccaccggtgagctccttgacgagttccttgacggcgggcatacgagtggaaccaccgacgagcaccacgtggtcgatgtcgctcacggagatgccggcgtcgtgcagcacgttgttgaacggcgtgcggcagcgacccagcaggtcggaggtcatttcctcgaagtgcgcacgggtcagagtctcatccaggtgcaccggggtgccgtcaggggtcatggccaggtactgcatggagatgctggtggaggtggaggaggagagctccttcttcgcctgctcagcggcttccttcagacgctgcagcgcgatcttgtccttggacaggtcgacgccgtacttgttcttgacttcggaaaccagccaatcgatgatcttctgatcccagtcgtcaccaccgaggtggttgtcgccgttggtggcctgaacctgaatggtggagaagccgtcgtcatccttgccaatctccagcagggagacatcgaaggtgccgccgccgaggtcgaagaccaggatgcgctcgtcttccttgcccttctcaaggccgtaggccagagcggctgcggtcggctcgttgatgatacgcaggacgttcaggccggcgatcttgccggcgtccttggtggcctgacgctgggcatcgttgaagtatgccgggcaggtgatgacggcgtcggtgacgggctcgccgaggtaggcctcagcatccctcttcagcttcatcaggatctgcgcggaaatctcctgcggggtccacttcttgccgtcgatgtcgacggtccagtcggagcccatgtggcgcttgacggaagaaatagtgcggtcaacgttggtcacggcctgacgcttggccacttcgccgacgaggatctcgccggacttggagaaggccaccacagacggcgtggtgcgcgcgccttcagcgttgacgataacggtgggctcgccaccttcaagagttgcgatgcaggaattcgtggttcccagatcgataccaactgcacgtgccataatgtgtgctccttaattactcgtttgttcttacgttctttgcccaagttccgattggtcgtctcttggaccttccaaacttgagcctacatcactcaacttccatttggcaagttctattcccaatttcaacacaaaaagttgagcatgtttggctcaagttttttgtgggagtgactgacggcgatgacggagtggtgcgtttggagccaaaatccacttatacagaaaactgcaaggggtgactggggcgcgccatcggccttgtcgtcagacttaccatcggcggcgcgcgattgcggcgcatggggtgcgtcggcgacgttattgtcgctggggcatcgatgcgctgaataactcagacacagtgtttgtcgccgattttctgcgggaattgttcggcaatatcgctaggtatgccgattcgacgcagcgttacgtggtgctggtttccgccgctcaggaccgcgtcaccattgatgtgacggaccgtccgcgtcaaggtgacgcgacgtttgagggggcggcattccgggcttgcgtactatcgggagcgtgtgctgcatgcgcacggggattgggatgtgcgggagaaacgcgggcagtgggtactgcatgcttcagtgccggtcgataacgctggctaatcgacaacaccggctcatcaataacgccggctaattgataccgccaatcactcgataacgccagccagtcaataacgccggtccccggccgcgccggcgtgggtcgcgagcgaggccgccatcgcgaccgcgcagactgcggcggccaccgcgacgcccttgtgctgtttcaccttgtgcatgaaaagttcctttccactgaccgcacgatgagtgcaatcgcgaaggccatcccacgcactgcacccggtatgccacgctcttcggcaaccatgccgaacttatcgccgcataccggggcgcacccggatgttgcagaaaactgcaaccgggctcagctgcgcagcaaaatttcttcgagcgcgccggccaccgcatcgggcatgtcggtgatccagaaatcgttggcgtagcgcggaccacggttcatggtgcgcagggcgccgatcgcgccgatgccgagcttgtggaccgcctgcagcgcgagctccttggtgcggtagagcatctgggcgtgcagcagtaggtccatcgcgtccgattcgaccggattgtcggcgatgcgcagaccgccgggaatctcgatgcgcagactggcagccgagctgatgccggtgacggacacggtcaggctcatggtcgcctcgtcgtacgccaccgtcgcctcgaccggagcctcgccggaccatgcacgcacgccgctggccgcgtcaaccggcgcgacgccgcggaacacgaccgtccagtcgcgcgactcgggtacggcggacgtatcgccggtaaccggcgcgacggtgaaggcgctgggcgacgcatcggccccgccccacgtgaacgctatcgcggtgtcggcgctgggggcgccccacgtgccgcgatcctcgcgcatgacgaacgagccgtcggcaccagggaacaccagcacgcgcagggcctgcgggttggcgatagagttgatcgcttcgccggattccgcgacgtcctgcaacggcacgatcgcgccggccttggcgaacaccggcgtgcggtcgagcgagcgccagacctccagtcggcggccggcggcgtcggatgagacgtatcggcggccgtcgaagaagtcgaaccactccccctgcggcagccaggcgtcggcgcggccgcggcaggcggcggcatcgtccggggagacgatcggcgcgaccacgagctcggtgccgaagcggaactcatccggcacctcgtaggcgtccggcgtatccgggttctgccagtacatcggctcgaccagcggacggccggcttcggcggcacggtagttcatggtgtacaagtacggcatcatcgcgtggcgcagacgcagcgcgtccaccatcgcggcgctcacgtcacggttgaagttccacggctccttgccggagaacggcgagttggacgaatgcagtcggttgatcgggctgaacgcgccgagctggtaccagcgggcctccagctcttcgttgcggtagccgaacatgtggccgccgatgtcgtggctccaccagccatacccgatgttggaagcggtggcggtgaactgcggctggaaggcgagcgattcccaggtcacgatcgtgtctccggagaagccgaccgggtagcggtgggagccggggccggcgtaccgggagaaggtgagcggccagttgccaccgcgccctgagtcgaggtagtgcatgtggttgagcatccacagcgggtcgagacccttctggcgggtcacgccgccctgctgccagtccagccaccagaagtcgacgccttcggcctccatgcggtggtgcatgtcgaaataggcgtccacgaagtccgggttggtgaggtcgaattccacgttctcctcggtggccgggtcgatgccgacgcgcttggcgacttcggggtaggcgtcctcgaacgcgcgcacgccgtcgcgcgggtggacgttcagtgtggtgcgcaggccgcgccggtgcaggtcggcgaggaaggccggcgggtcggggaacagttcgcggttccacgagtagccggtccagccggaaccgtacttcgggtccacgtcgtccacgcgatgccagtccatgtcgatcacggaggtggtgaacgggatgccctcgcgcttgaagcggtccatcagggccagatagccgtcctgcgtgtaccggtagtagcggctccaccagttgcccatggcgaagcgcggcaggagcggcgtggggccggtcaggcgatagaagtcgcgtacggcctcgatgtagcggtggccatagccgaagaagtacaagtccgtttcggcggtggcgcgcggggatacccaggtgccgaacgggttcgccttgccgttcaccgtgtcggtttcgatgatgatgttggcggcggaatcgtcgatgacggcccagccgtcgcgcgagatcacgccgttgtcaagctcgatggcgccgtccgcctcgtccagcgtgcgggcggtccctttgaggttgccgcgcggggcgtcgccgtaatgccaggtgttgaactgggtgtcggccacgcctttgacgaccacactcaggccttccttgctgaacggctgctggtcgtagacgatggtcagggccgcggtgtcgatgatgacgcggccgtcacgctcggtgacgcggcgttcgactgggctaccgaaatcgcggttcaggacggtctgggtcgggcggttctcgaatacgccggaatcggaccattcgaatcgcacgagtgaatcggtgatgagtccgatgcgccagtggtcgccggacaccacattgtcggcgcgcatggccggcgtggcgtcgaggcggaagtcctgcggatcgggcgaggtcggagacgaatgcttgagttgtggcgattgtgccatggttactctttctgtacggttatccacgatgatacgagtgatgcggccgcggctctccgggactggtgggagactgcggcgcggttcggattcggccgaaaccggccgggtttacttgccggagccggtggcgatgccggcaatgaactgcttctggaacaccaggtaggcgatgaccaccgggatgatggtcacggaggtggcggcgaacagtccgccgtaatcggtgccgtactggccggagaacatcttgatgcccaccgacaacagctgcttgtcgtcatcggtgatcatgaggaacggccagaggtagtcctcccagttccacaggaaggtgaagatggcgagcgcggcgatggaattgcggctcatcggcagcaccacctggtggaagatgcgccagtcgctggcgccgtcgaggcggacggcgtgcgggcggagcagggcatcctcggagttgtggacgttgaacagcacgggggcgttcttgttgcccttgagcgagagcggggtcttgacccagtagtcgctccaagccacctgcgagatcttgaaggtgacgttcgggtggatcttctcgtactcgtggagcatggagatcaccgggtcagtgctttcgtcgccccaggaccagtagcccagttcgatgggctggccgtcgttgaccaagtggttggggtcgtaggtgatggtgtcgcccatgacggccaggcccttgtcggcctgggtgtcgacgacgcctgacgaaccgctcgaactgcaaccggttgcaagtgccataatgctcacggttgcagtcagcgcggcgagagatttcttgatcttcattatctcccttacttcctcgcaagctctaagtgaacacggttcagtatacgggtgtcgaactagttcggtaacccggctttctcagccatgcaaaccgttacatttgcaacctgttacattccaaagctattgagaccatattggtctatattttcggcgtgtcgcaatatcgcaacccattgcactatgactgtcgtaaaacgtactgcaatgatttacaatgaagagaagtttgtcacaccgtcaactttgaaaaaccgggaggggccatgaaagccagcatcgaggacgtcgctaggcaagcaggcgtctccaccgccacggtctcccgcgcgttctcccgccctgacatggtctccgccaaaacgcgcgccaaggtgatggaggccgcccaacaactcgacttctcggtatcccgcatggccggcatcctcaaatcgggccgctcccaccgcgtggcgctgctggtgggcagcagcaagctcgactggttcacctcgcgcatcatcgaaggcctcaacgaagtgctgcgatcggccggctacgatctggtcatccaaccgatcggcgacgcgggcgcgcgcgaggagttcttcgacgaactgccggtgcgcggcaacgcggacgcggtcatcgtctcgtcgttcgccatcaccccggccgaaatcaggcgactcaacaccacgcggatcccgctcatcggcatcaacacggcctcgcaggggttcaccgcctccgtgggcatcgacgacaaggccggcatccggctgatcgtgcgccatctgaccacgctcggccaccgcaacctgttgtatttgtacgagacgttcgatgccacgatgggcttcagctcgcacaaccgcgtcaccggattcctggaggcgtgcagcgaactggacggcgtgaccggccagacgatggacatgcaggccggcgacgatccggtcgacgccgccctcaccgcgctgctcgcgcgcgacgacgccccgactgccctgtgcttccatcaggattcgctggcgattccgctgttcttccgcctgcgccaatgcggcatggcgattccgaccgacctgtccgtcaccggattcgacaacagcacgttctcgggcgaggtggggctgaccaccgtgcgccagaagccgtacgacatggccgtcgccgccgcgcgcaaggccctggaccttatcgaggggcgcaccctggaccagccgcacgagatcttccccgtgcaactgctggtacgcgactccaccgccgcgccgcgggtgcgcggctgagcggggccgaatcagtcgttattcgggccgctgttgtcggactgggctttgccgttcctgcgagctatcgccatgaacgtgacgccgacgatgacgggcaggaggatggcggcgagcgttgcggcgcggcggatggcatcggacgttgcctttccggacttggcgtcgcctgacttggcggacgctgcggaatcggcggacttggcggcggtgtcatcgcccttatgcggtgtttcgccggtgaaccaggcgggatcggacggatcgtatttccgggtgccggcccagtttgcgggcgtcgcgccggcgtatagggcgacggccgagcccttggccacggtggcggtgaaggtgccggccacggcgttgcggcagccgatcatgccgcggatggcggtccagcgttgcgcgcagtgccaggtgccggcggtttcgatgccgtcggtcggacaggtcatgtccggcacggaggtgcgggtggcgccgggagcgccgtcgtcgacgccggcgtagtagtagccggagaagatgtgcggctggccgtaatcgtaggcgagcatgaaggcgttggcgagcaggtagctggtgccgtcacgggtggtgagcgaggagccgttgcgctcggtgtcccagttggtcacccatacggccgccttatcggaatccacccaggtcggtccgccgatggcgtccaggccatccgaacgaatcgatgcaggccggcttcgacatggacctctacctcgactggcgccgggacggccacccgaacggctacaacctgttgctgcgcaataccgacacgcctatggagcacgaaggcgattccagttatttcaacgccgattcaggtgcctcaatcgcctcattcctcacggaatacctgccggacgagctctcttccgacgccgacgtgctgctcagtcttggtgaaccggccgtgagcggcgggcagctgacgctctccccgcaatcgttcgtcgtgtttggttaaacccgttcgacctcacctccgccggcgaggctgtcggcaaagtcgactggggatagtcaacgggccatcacgacaaacaccaacacctctagcctcgtccaactcaccgaatgtattgcaatcgttgtcaatatgagttacggtagaggcagaacagctcgaacattggtctgtcaggttgccggaacctcaacgcagagcggccctcgaacagcaatgcaaacgactagcagtacccgatttgcaagcaaggagtcatcatgaccgacgcatacggcaacgacgcagcaaccagcaccggcaccatcgcagacaccaccaacaacgccgcttccggtgccccgcagcgcgcggaaagcacggaacgactcgcccgcccgctcatcaagctcgccaaagcctgcggacttgccacctcattcatcgaccagctcggcacctacaccgaaatcagcgacgcggccttggtcgccgtactcaaggccctcgacgtggacgcatccagcgacgaggccatcgtacgctccatgacccaacttgaggtggaaaacagcaaacgtttgctcccctccaccatcgtcgccaccaccggcaaaccgaccggcatcaccctgaactgctcgtcggacgcggacatcaccgcctccatcgaactggaggacggcaccgcgtttggccactttgccctgctgccgaacctcaattccggcaagccggacttgaccatcgcacccgacctgccgatgggttaccacacgctgaccgtcacggttgacgggcgcgagggcaaggcggccatcatcgccgcccccgcgcgcattcccgtgccggaggcggtcgccgagcaccagcggtggggctggatgacgcagatgtattccgtgcggtcccgcgaatcgtggggcatcggcgattacggcgatctgaagcgtcttttggcagatgccgccgagaagtccaaggccgacttcatgctcatcaatccgattcacgccggcgcgccgattccgccgcttgagccatcgccgtatctaccggaatcgcgccgattcctcaacgtgacgtacatccggccgcaggatatccccgaatatgccacactgccggccgacgtgcgcgcgcaggtggatgcgctgcatgattcggtggccgcgcgcaacgacgaatcgaccccgatggacatcaacgcggcgtgggaggccaagcgcccggcgctgcgcctgatcttcgaagcgggccgcaacaacaagcgcgagctcgaattcgagcatttcaagaccaccgccggcccggacctcgattccttcgccacatggtgcctgtgcttcgaggtatggggcgcgccgtggggcgagaaccgttggttcttcgagaagaccatcgacgacccggccgtgcgccagctcgtcgaggagcaccacgacctgttcgagttcaaccgctggctgcagtggatcgctgccgagcaggtgaacgccgcgcagcaggaggcgctggaccacggcatgacgctggggctgatgcaggacatggccgtgggcgtgcacgggctcggcgcggatgcctgggccaatccggaacgcttcgcctcaggtggcgtcacggtcggctgcccgccggacttctataaccagcagggccaggattggggccagccaccgttcaacccgcgctacctggaggccaccggctaccaggtgtaccgcgagatggtgcattcgatgtacgagcacgcgggcgcggtgcgcatcgaccatgtgctgggcttgttccgcctgtggtggattccgcaggggctcggtgcccgcaacggcgcatacgtgacgtacaaccacgaggcgatgttgggagtactggccatcgaggccacgcgcgccggaggcatggtggttggcgaggatctgggcaccgtaccggattacgtgcgccgcattctggccgatcacggcgtgctcggcactgacgtggaatggttcaaccgcgtggacgattcgccgaacgccggcgacccgtaccgcgcacccaaggactatcgcaaacaggcattggcctcggtgaccacgcacgatctgccacccaccgccggctacctgaacttcgcacacgtcaagctgcgcgaggagctgcatctcctgagcgagccggtggaggcattcgccgcctcggcgatggccgagcgcacggccatgatgaaccgtctggtggagaacggctatatctcgcagaccgtggcggatgatgtggaaggccatgtgcaggaaatcgtggaagcgatgcacgccatgctcaccgatacgccgtcgctgctgctgcaggcagcgctggtggacggcgtgggcgaatgccgctcccagaatcagccgggcacttccagagagtattcgaactggcgcgtgccgctggcggacagctcaggccacgtggtacataccgacgaggtcttcgacctgccacgcgtgcagtccctagccgccgtgatgcgccgagagaagcggtgatcgattccggcaatgggaaattggtctaaatcagcccctcgtaatcgagatagccgaagacgacgacttgttatgggcatgttatcgttgtcatgacaatgattgttcgcgacggcgaaggagcgacggctatgaccaaggcaagcattcaagcggtggcccgcgaggccggcgtttccgtatccacggtgtcccgaaccttcgccaagccggatctagtgcttccagagactcgagaccgagtgatgaccgcggccgaaaagctcgactactccgtctctcgctcggccgccgcactgaagtccggccagtcgttccgcattgcgctgctggccagcgagaccatcaccacctggttcaatgcaaatatcttcgccggccttgactcggcgctgcgcccctccggctacgacactgtgccctaccccatgcgcaacgccgccgagcgccatgacttctttgcggatttgcccgtgcgacgcaatgcggatgcggtgattgtcagctccttcgacattgagccggctgaagtggagcgactgaagcatatgcacgtgccgattgtcggcatcaacattccctccaccgatgggttcgacgcaggcgtgagcattgacgattacgccgccacacgttcggccatcgagcacctgattgcactcggccaccggcatatcgcgttcgtcggcagcgccccgaccgaaaccaacatgcgctacagtgccgaggctcgtttgcagggcgtcattgatgccgctgccgcccatccggggatcgagctaacgcccctgagcattcaacgcggtcttggcgaaagcaacgcggcattgaacgccgtactgaacgcctcccccagcatcaccgccttctgttttgaggatgatgaaatggccgcacccgtgctgtatcgcctgcgtcaatacgggcggcgggtacctcaggacatctccatcatcggcttcgacgattccaccctgtccgccgccgtgggactgaccacactgcatcaggacccgttcgcaatgggcgtggccgccgggcacatggtattggatgccattgcgggcaagtcaatcgaaccggcattcgtacggccggacactccgctaatactgcgcgaaaccaccgcgccgcctgccgcaacagcagcgtccgcgcaggcgtgactacgttaccaccgcaaaacgccgataaatcgacttttgcatgcgtaattcacatgatatcgttgtcatcatcaatacaacggttgggccttcacacagcagttcgagcacaaccggaacaacccaaccacaacgcacccggaacaggaaggaatcggcatgaccgccaacaacctcaatgacgactggtggaagcaggccgtcgtctaccagatctacccgcgcagcttcaaggacgtcaacggcgacggactcggcgacatcgccggcgtcaccgagaagatggattacctgaagaacctcggcgtcgacgcgatctggctctccccgttctacccctcggatctggcggacggcggctacgacgtgatcgactaccgcaacgtcgacccgcgcctaggcaccatggacgacttcgacgcgatggccgaggccgcgcacgaggccggcatcaaagtgatcgtggacatcgtgcccaaccacaccgccgacaagcacgtgttcttccaagaggccctcgccgccgagcccggctccccggcgcgcgaccgctacatcttccgcgacggccgcggcgagcacggcgaactgccgcccaacgactggcaatccttcttcggcggcccggcctgggcgcgcgtggccgacggccagtggtatctgcacctgttcgataaggcgcagccggacgtcaactggaagaatccggacatccacgaggagttcaagaagaccctacgtttctggtccgaccacggcaccgacggcttccgcatcgacgtggcgcacggcctggccaaggatctcgaatccaagccgttggaagagctcggccgcgaatacagcgtggtcggcgtgctgaatcatgacttcagccacccgctgttcgaccgtcgtgaggtgcacgacatctaccgcgagtggcgcaaggtgttcaacgaatacaacccgccgcgctttgccgtggccgaggcgtgggtggtgcctgagcaccagcacctgtacgcttcgatggacgagctgggccagtccttcaacttcgacttcgcgcaggccaactggtatgccgacgagttccgcaaggccatcgccgcgggtcttaaggcggcggccgaaaccggcggctccaccaccacgtgggtcatgaacaatcacgacgtgccgcgcagcccctcccgctacggtctgccgcaggtcaagggcgcgccctaccaccagctgccgcacgactggctgctgcgcaacggcaccacatatcccgaagaccgcgagctcggcacccgccgtgcccgtgccgccgcgctgatggagcttggtctgcccggcgccgcctatatttatcagggcgaggagctgggtctgtttgaggtggccgatattccgtgggatcgactggaggatccgaccgctttccacaccgctcaggccacgatggataagggccgtgacggttgccgcgtgcctctgccttggaccgcttccgacgagcccgctctggccgatttcagccgtccggctccggccgacgatggcaccggcgagaaccatgtgccgctgtgcgccgccggccagttcggcacgggcgcttccttcggcttctcccctgcggttcgcgccgatggcgtgacgccggccgccgacccgcacctgccgcagccgctgtggttcaaggattacgcggtggacgtggagcaggccgacccggattcgatgtacacgttgtatcatgcggcgttggcgattcgtcaggagtcgctgaccgccacgcgcgacaccacggccgagcaggtgggcatgggcgacgatgtggtggcgtacacccgcgcggcggttggcgggcgggtgttcacctcaatcaccaacttcggcaatgctccgatcgcgctgcccgatggctccgtggtgctggcgtccggcccgctgacccccgaaggccagctccccaccgacacttctgcgtgggttgttcagtagagcttttgcgagcttacccgacgccagtcatccatcttctccggatgctggcgtcgtcctttttcccggctaagctgtctccatttcggggatgactgccctttctttccattcgcgacatgccaaccccgaaatacttaataatattctatatacttaacaagagatgtgaatcttacagattttcgttaaggattgaggtcgacatggatgccgagcattacattcgcgagacacttggtctgccctgccaaatcacttcttggaatggcactgcctcactgccgctatttctgaccaacggacggacattcagcaaactcaccatcgacaacacgagcatgctaatcgcgagcggagaggctcacccattcagcatcacacgcgtcaccgccgacgccagcaggcttgagcagcggacggatctgcccattgtctttcagtttccccggctttctgcataccagcgaaaagccctgattcagaatcacgttcctttcatcgtgcccggtacccaactgtatatcccttcactgggcatggtgttcacccagcgcatctcctcacggccgctggagaacgcacaggatatcgaggtgcgacccttctcccccgcaacacagctggtctggctgtatttgctctactccaacgagagcaaagtccaatcagatattgcccgagcgcttcagtttaccgaagctcaggtcagcgttgccgtgacgctgttagaacagctggcattcgtgcaccgcaccaagcaaggccgcagcaatagcgtcgaactactgacttcaaggcagaccagccgacttgatttactgaaatcatcttggcatctcctgaagtcaccaatattcagcaaatataccgtcacgaatcgcaatcgccagatgattgccgacgagctgattccggccggcgaatttgctctttcgcacaggacgcaactggccaccccaaaactgcgaatctatgccgttgaacgtcattggctcaagcagcacaacaaggaactatgcattatcgaccccgctttggaaaaggtgccagataatgcatatattctggagctgtggaggtacgatccccgcctacttgctcaatatacgcaggaagactaccttgccgaccccatttccacggccctgactcttggcgagattgccgacgaacgtttggaagacgccatacaagaatccatccgcaatactttctcaggagcgacaatatgacacaaggcctgcagctcatcagaacggcctttgccggctacgaagattcttacgtaatcatcggcggcaccgcttgtgacatcatcatgaccgacaacgaactggacttccgagccaccaaagatattgacatggtgctgattgccgagggacatcttcgcgagtttgcacaacgattgtggtctttcattcgcgatggcggatacacctctatcacgaagaactccgcacagcctcacctgtaccgtttcatgcaccccagtacgtacgggtatcccactatgatcgagctattttcacgtcaccctgacttccctattgtgccgaactcgttcctgacgccattgcatattgcaaacgacgtttccagcctgtcagccatcatgctgaacgacagctactatcggctactgcagcaaggccgcgaatcaatacaaggcatcagcgtgcttaacgagaaatatctcattcctttcaaggcgaaagcatggttggatctcaacgcccgagaacaacatggcgagcacgtagacggaaaagatctcaagaagcataaatatgatgtattccgtttggctcaactacttgctccagaggatcgcgtgtctctcaacgacgaggcctaccatgatctcgctgattttcttgggaaaatatcccatgaaacgcttccgataaagcagctcggcatacggggaacacagcaagacatcattgatttgatagccggcgtatatcaactgtctatcccaccacgcgatgaactgcccaccacgcgatgaatcttctaccacgatgtcagcgtaattttgtattccgcggaataaagccgttttgcgtcaccacgtggtgggtagtttgctacgtcgtggggattttactacgtggtggaggtttgactatatggtgggaccatactagaaggccgccgttccgaatgaatcggagcggcggccttttggtacgtgctgggtactcccctcaggcgcttatgcgccagcgggagctacaggggctcactgaacctgagcgcgggcgatcttaccggtgaaggaattggcctcgtcggcatccttgacgccatccttgttccaggagaacatggcgcgcagcttcgggccgacggtctcgatgcgctcgttggagtacttctcctgcagctccttgaagtgcggggcgccggcatcctggtcgtcaatgaactccttggcgaaggagccgtcctggatgcgctgcaggtggtattccatgcgcttgcggcagtcctcgttgatgacggtgttgacgtagtcgccgtactgagcggtgtcagagcaggaccaacgagccttgttcagaccgccctcgttcatcaggtcgacgagcatcttgagctcgtggcagacctcgaagtaggcgatttccggctggtagccggcgtcggtcaggacttcgaagcccatctcgacgagcttgttcacgccacccatgagcacgttctgctcgccgaagagatcggtctcggtctcttccttgaaggtggtcttgatggcaccggcgcgcagggcaccgagggccttggcgtaggccagggtcagagcccagccgtcgccacgcggatcctgctcgacggccacgacgaccggcacgccacggccagcggcgtactcacgacgaacgatgtgacccgggcccttcggggcaaccatgaacaccgggtgatcctcagacggcttgatgtctacactgcggaaaaacaccgctcacaaagcggacgccaacttgctaaaacacaggcatgtcggcgaccggttcgacctccagcagccgaaatcctgatgacgctaacgacgacggccgccgccacggtcgtaaccgcggcgcttcctgccgcagcgggagcatcggagcatgcccccgcgtggacgcacgcggatctcgagcacgggtccggaacgcagcggcgaatccgtgatccgcacatcctcgaccaccgtgcctttgacgttgagaagctgtttgaatatgccgttcatcaggcgcctgccgccgggtagtacgtttttcttggtcgatgaacatcccacccaaaaaaacgccccccaacgactcaacgacgaaccgccacccacgaaaacagcaatagggcccaaaaaatcggacgttatcttattgctacggtacataacgcacgcatattcgcgaggaatgctcactggaatatatgagggaatgctcacaacacttgagaagggacgttgttatgcaaatcatgtatgtatgcaccggcaatcaatgccgttccgtgatggccgaatactacacccgagccaagcttgtcgaccgaggaattggcttgcagagcggcaatatcaccgtgcgcagcgcgggtactctgcactatcccctcatcccgctgatccgatggttatcgatttgctgaagaacgacggcattgacgcgaattcccattcttccacccctctcaccaccgatatcagccggcaagccgacctgattctgtgttttgagcgtgagcaaatttccgatttgcttgagcagaatccactggctattcgcaaagtatttctgttcaatgacttcgtgaacgcttgcaaacatatgcatgctgagggtccgattgccggcgataccgccgcagacaagctcatcgaaatcatggattgcgtacctatgctgcggccgttttttgcctacggcactcgaaaccgaagaccctcatcgtcaatcacgcgaggtgtttgaacgcgtgtatgcggaaatcaagcacggcgtcgatattatgctcggtgctgtggcctgaatgcaatatcggcgaatagagccagcaaaaaaggccgtcagttattgcgatgttgaaattgcatatttctatattcaatacggctgatattgcgggctcttgttttcctcttttcttggtattggttaaatcggtactattcggggagcggaatacgtaggtcaaatgttcttcaatcatgcatgcatatgatttgtataatgcgaaattagctggttacaattagtgacgtaaataaaaaacacgtgaccaatgcaataaggagagcaattatggcttcattgcttcagggattcgaagaggttcagctggtcaagccggtgggcaagaccgttctgaccgttaccgattccgccattcgtttcaacaaagccaccgctgaagtgctcggattcccggcgtacgtcaaggtgctgattaacgacaagaccaagcagatcgccgtgaccccgaccaccgccaaggccgacaacgccattaagttcagcaagcccgaaggcaagcaggccgcttcggtaagcgtcaaggaagccacgctcattgaagcagtgaaggcatacttcactctgcccgagactccggaaggtgaaatcgcctaccagtccgtcaacggtaccgcctaccccgaaagcaagaccgtgattttcgatgtggccaatgccaccgctggcaccatgaagcgccgcggtcgcaaaaaggccgcctgattcgacacatcgaactggatgcattcttgccggtagggccaaggggacgtcaaccgtgaaggttggcgtccttttgtttgcacagtccatgctcggtatttcatcgtcagacaaggcgtgatataacctgagaacaacggattttcagggaggacagtggttcggatgcctgcatacgcacatgaccagtacgaacgcggacggcatgttatggccgagaccgagacggacaagtcatctgctgcatccagcgtcgaaaagggcagcagcggaaagccacactccatcatcacgtatggcattaacatcgcgatcacgacggcgaatcccgacgagaacattttggatcgccgacccaagcgggccgccgtggatttcgccgaaatcatcgccgcaaaccaattggcagcagtacagtagacgatacatgtgcagcagcttctgcacacgcacaccaccatggtgcgcgtctcaagtagccctgcgattatcaatctctccggtttcatcaccctcagcacgtggaaggccattagcatcaagacgaccttcaccggcgcaaaatgcttcgtcaacaacgcggccctcttcatccacagcatggagcagcaaaagagaacggcagccaacgccaaggccagcactaatctgcaagcgattgccgacctgcgcgacctgaccaaccgtggccgcgtcaccgtcgacatcgacgccgaacccacacgctccagcctcccccagcgcaaagcccacaagcatatacagctgcattaaactatgagtcatagtgaagacgaggggccggaacccgtcaagggttccggctattccgctgacgaatcagcggcctcgcctgaggctcagaccaagcaacaccagtgtggcgatgatgatagccgtcgaccatccctgtccaacttggttggccagagcgatcaacaggcccgtcatcaggccttcccggtattgccggtcagatctcggacggttgtcatggtcattgccttccatgagaacctcctctttagttgtaaccagtcactatgcctgctggcacaatgacaccgtgccaagacgccacgctagtagttccttggtttggtctgtccagtgtacgggggaaggttcgatggatgctggtatgctgtgttctagcagaaaggtcgcgctagcttcggggcaatcttctaggcggcgccactgactttcgcctcgttggacctgactgccgaggtttcctcaacctcagttgtaatcagaaaggtctctggctggtgaattcagtcggagaccttttactttttcaattccaaccgccttcatcaagggactcacccaagctgatttatccgagcgcaccgggctaagccgcccttggatcaaccaattcgaacagggcaaaatcgagaacgccagcatcggccgtatcctgacattgtgcaacgcccttggaatcactctcacagtttcctacggcacccccgaggagacaaacgaaacagcccccagtaacgcacaactttcactatcgatgccgggccatacgctcatgtcaagagctatgcgattctggaaccggtcaacggaacgccccggctggcaccactctatgacaatccctgttcgcctacgacacgcaacacaaagcacacgcatcctgcaatggttcactgatgccgagtaatggtcatagatgacctgcgcatataacacaagcgttccgcacgtcctcagggggcccatgatagaggggtgttcctatgtttttgtcaatctttgtgtggggtgtcgtgttggtgtgtggggtgttcctatgttttttgtcaactccttggggagttgacgtgtcgggattccggttggctgtcgtgggaccgtgagctccccagctgatgagcgcaaaggcagagattggtttcacgcgggattgtcccgatgtcaaggtcatgatgcaaaagcgttaagcatcctacggattatattgagaaaagaagtcattagtaatacaattggctttggaaaggattcattatgagcactaccactgttcgcatggatgatgatctcaaagctgaagtgaacgccattcttgattccatgggattgaatttcaatacgttcgtgaatatggccagcgtgcagttggtgtcgcagcgtcgtattccgttcgaggtgaaggcgcctgaacccgtgctgcctcgcgcgggacatgttgccgccaatggagttacgtaccgtggggtcgacgaacagggatatccggtggtcgaagtgccgaacgccatggtgttgaatccaagccggggcgccgatggtgttgccgtactgcccaaggcgtggcgcgatggcgaatgattatgatattccggaattgatgccggttccggagcaattgcatgtcttcgacgtgtatcgcatgcaggtgcggttcgaggatgatccgacgaaatcacgcaaccattacgtggccgccatcgtcatacaagccgacgacgacggtggagtggctgtgaaactgaccagcaatccaacctggcatggggcgggcgatgtgcaactgcccgagtatgagcatgccgggcttacccatctgacgaccgctcgctgcgcgcagctggtgcggttcctccggtcggatctacagggattcaccggtagattgagtcggaatgatgccatacgtgtggccaatgcggtcggcgaggtaaagcctgaagaacaggtgtggctgtaattctgttctgccgtctaactggttcggggtactcactgtgaaccagtgcacaattgcgatggtcggatgtctttctacagtccgcttatatgtgaaggttttgtggtcgacgttgcgtcatatgttgcttgtgacgttgcgtaatgcggcatattgcttggtgaaaggaggttaggtcatgtcgatggacgatgaaacggacagccgatacaccacaggggacatcgccaaactcactggtgtgagtgtgcgaaccgtgcagtactacgacgccaaaggtctgttgattcccaatgagatcagcgacggcggccgaaggttgtatggggctgcagaggtcgagcggatgcggggcatcctttttctcaaaggactcggcttcaagctggagcagattcgctcgattctgtcggacgagcggccggaacgggtgctggttgatttgctggatcagcagacggcatccttgcagtcgggtatcgccgagcagaagcaacgtcttgatgactgcttgcagctgcgcaaagcactgacggtctcggcgtctgacttcgtatcgtcaacattaaccgacatggcaaccgttatgaacaccacaaccactcattccctgcgcaccacatatttggtcatgttggcaatcgcattgcccgcgactttgttgcaaattgcatgcctcgtcatcggtgtgatgacagacgtatggtggccgctgccggtcgccgttctgctggcgattgcgctcactgttgcggcgatgaagtactatcgctcccgcgtgcagtacctatgtccggcttgccatgagaccttccagccgggtatgcgagagttcgtattcgccgcacacacgcccaagacacgcaagcttacctgcccgcattgcggtcacagggggtactgcatggaactcagcatctgaaagtttctgattatagcgttcgatttaccaacggtagttgtcgcagaatttgcgacaactaccgccctgtcaaaatatgtgcgttgtgcagggctaaattgttccaggtcgcggctcgggcggtagggtctgccgttttatcgctgcttcggcgttcctgttgctgattgatgggtgatattacgcttgcgtcggatccttctggagcagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgatccttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcactttgcagccgaaccggccggccaaacgaccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcgggcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactgggggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgtgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgcctgcgcgtgtgcgtcaagtgcctcaaggctggcaaggttcagcgcgtggccgcgtgaatcgcgtactaacgtggagcaaaacccgtttgagcttcggcttggcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccctgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgatccgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgaccccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcggaaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggcgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgcccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattgcggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccacccaggccggcgtgactaattatcaggctgcgaacgccttctacgagcttggtgctcgccgtgtggtgttggcccgcgagatggacttgcaggccgtgcgtgatattcgcgccaacattcccgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctgggacacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgccccccgctgactggggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcgccggcgattacggcaacctgaacctcggcggcaagtccggcgacgaacctgaggccgtgctgtcgaaccgcatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggagcgcggcgtgatcggcgccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgccttcgccggtgtacatcaggtggtcgattcgatgccgcgcgtgcacgccgccacccagtaccttgaggaagacccggaactcgccgaactgtgccgtacggacggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccttacggtggtgcctatgactgagagagatttcgatacccccgtcgagacgcctaccgtccaaccggcccccgctcagggtgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgatcgcgtcagcgacatcgtggtggtggtcaatcccaaggtgcgcggtgaagtggaaacgttggttggcgagatgggctacaccaaagtccgcgtcatcattgacggtggtgacgaacgtgtggacagtaccgccgccgcgctcgacatgctggctacggctggcattccggacgatgccaagattctgatccatgacgccgtccgtccgttcgtggaacagtccgccatcgacggttcgattgatgcgctcgaccagttcacggccgcaaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaactcaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctagtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgcggcggcattgccggtggttgcgcccgtcccggaagtcaagcctgtacacaacgaggccgatgaccagccgggtgagttgagcggaaacgagtcggctgccgacgatcacaatgagacagatgcggcaccggctgattcggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggtacctgcgctttcgagccaggtgccgtattcgtttgaatctgcgccacaagcgcaccatcacagaaggagtatgacatgagtgaattgacgcctctgaccgacgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttccttcgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccacgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacacaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactgagttgcgtcatcggctctctcgcgggagcaatgcaacgaaacgtctctacccctcagcctgccattcggcggccacctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgcacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttctgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggccatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgtcatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggttttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttctggcgtgatctccaccgtcaagcaggccgacggcaccatcggctacgctgacttctctcaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcttacccgattgtcctggtctcctacgacatcgtctgcccggcctacaaggacaccaagcaggctgagttcgccaaggcttggctgacctacgtgacctccgacgagggccagaaggccgctcaggatgccgccggcaccgttccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcgcctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggtgagacgatggccgtgttgatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgtgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacgatctccctgctcgtcgacgtgatgagcggcatcccgtccatcgtggccggcctgttcgccttctcgatgttcacgattctgctgggccccggtaccatcaacggtttcgaaggctccgtggctctctccctgctgatgttgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctacatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcgtcgtgctgctgctgaacctcattggccgaatcgtggcgaaggtcttcgccgtcaagaccgagcgctaagccagtcgctaagcctaagccttaagaacacaaggaaatataaggaaacatcatgggacaacgtattgacgtcaaccacgagaacatctactacggcgactttctggccgtggaagatgtgaacatcaacatcgagccgaacaaggtcacctccttcatcggcccgtccggctgcggcaagtccaccgtgctgcgcaccttggaccgtatgcacgagatcatccctggcgctcacgtcgagggcgaggtgctgctcgaaggcaagaacctgtacgacaaggacgtggatccggtggccgtgcgccgcgacgtcggcatggtcttccagcgcccgaacccgttcccgaccatgtccatccgcgagaacgtgctggccggtgtgcgcctgaacaaccaccacctggccaagtccgacgccgacgatctggtcgagtgggctctgcgtggtgccaacctctgggaagaggtcaaggaccgtcttgacaaccctggcatcggcttgtccggtggccagcagcagcgtctgtgcatcgcccgcgccgtggccgtccacccgcaggtgctgctcatggatgagccctgctccgccttggacccgatttcgaccttggctgtcgaggatctgatcaacgagctcaagagcgactacaccatcgtgatcgtgacccacaacatgcagcaggccgcccgtatcgccgactacaccgccttcttcaacctgaaggcagtgggccagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcaaggcgggctttcgcatattcaacgcgagtattgccgagtattatcgttctcgcaacggagcgagctggaatactttgtcggactgggcggcgacttcccgcttcggtcgatcgacgggagaacggcgggtaaagcggtacaagacaagtccgcacgatgaatactctgtgatgaatcttctgtttacggtgcgagtgtggaagaatggtcacagcaaggtccagcaaaggagcataggtgagtactggtctgatcgtcggcattgtcgttgtcgttattatcgttgtcttgattggttggggcgtcagcgcctataacaacctggtgacgctgaagaaccgtgtgaagaacggttgggcgcaaatcgacgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgctgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtttgttccactttgaacaggcgcaatacttcgaggccgatgatgcctcccgtcaggtgccacaggtccagttctgacccgctccaggcccgtccggtaagccgccggccgggcccgtattgtcttaagagagggaagatatgtggatacgattcattcgcgccggaatcatcagcattgttgccacggtggtgttggcagttatcaccttggcgataatcgggacttccgcgttcggcgattcggccgacctcagctaccgcacgctggactatgacgtgaccgccaccgcgaacggtgatttgaaggtcacgcagcatatcgacgtcaagatgcgtgagcgtaccgacagtgacgacaacaccaagccgtggaagcaactgtttcagcaatacacgctgaactccggcaccctgactgatatcagcgatatcagcgtgcgcaacgtcaccgacggcatcgactacgcacaacagagcgagcccaagctgcccagtgacgtctcttccgacaaggaatggaacagcgactacgccaaccattggtatatcgccgatgtgagcgatggcagcgaccatccaaaggcatacacgcccggtaccgatggcctcaagcccagcgcctccgccaccgaagatgacacaaccgtggagatcggctggaatattccggtcaccaccgaggccgacagcatgaagttcgacgtgagcttcaccatgcacgatgtggccaccaaatggaaagacgtggcctccttccaatgggagccgttcggcaagaagaaccaagtgcctatcggcacggtcaccggcaccgtccatttccccaacggcatcaccggcaaaacctcatggacatggctgcacaccgagcgcacctcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgtcctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtaggcttgagccaaatgattgccgccgaccaaggcaagcagtatgcggcaggcatcaccagcaccatcgtgattctgccgctcgccattgatgaggcacccaacgcgcaacagttgggattgagtgaatcggaagatgcgctgctgaacctgctcatcgtcatttcgcagcgcgtgggcagcccggtattcgacctgaaccagatgaaggcgacctgccagaattggcaagacggctatattgagctcggcaaattcaccggtgcatgcagcatggaataccagcggctgggtgccacgcgctctgtgggctggcaatggatcctacccggcgtactggccgccgtgctgggatttggttcgctgctggccaacagctttatcggatacccggtggctggtcttatcgagctgccgatattcctggtcggcctgttctgctcgatggccggcgcgatgaccgtgctcaccgaccaaggccaggatatcgccggccggactctgggccttaagcgttatatggaagacttctccaacttcaccgaccgtggtgccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccataatggtccgttcgaccacgatgctgccgggcagatggacccgggcattagcggcccagctccggcttacggaggcacatcgtttgccggcggattctccgacctcggctcgcagctgaactccggactcgctgacatcagctcgaccatcagcgcggcagcaccatccgccgattccggtggcgatttctccagcttcggctcgggtggcggctccggtttcggtggctcgttcggcggttcgggtggcggctcgttcggtgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcgtcgcggcaaggagagcgcactggcgctcggcgtggacaccattgacctgctgtacttccaccgccccgatccgaaggtgccgtacaacgagtccgtcgaagccatcaagcagctggtggacgagggcgtggcgcaggaggccggtatctccaacgcctccatcgagcaaatcgacattgcgcgcggcattctgggcgacaagctcgtggccgtgcaaaaccagtactcgccgattcacctggagacccaggacacgctcgactactgcgccaaggttggcttggccttcgtgtgctggagcccgctcggcggctaccgtcacccctatgatgagaccaagttcgacccgttccgcgaggtcgcggcggcccacggcgtgagctaccagcaggtcgtgctggcatgggagctcgccaagggcgaccacatgttcgtgattcccggcgcgcaccgtcccgaaaccatcctcgactccctgaaggccgaccagctcgaactcacccccgaagaactcgccaagctcggctgaactttctcagctccccttgtcaggggagctgtctcgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatatcgcggtgccgctggccgcgcgtaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggcgcggacggctggcaaacggacgcttcgtggtcaccaactcccggctcggtggcggtccaccatcccaacggcatcggcggcgcaatcatccccgactccccgcgcgctccggaagcaccaggctcggcggtcgatttcatcatcaccgccgcgcgcgaatacggcccggacctgaccatcgtacctacgggcgcgatgaccaccatggccaccgtattccgcaacgctccggacttgaaggattccggtgtgaacgtgacgttgatgggcggtgcgttgacgctgcccggcaatgtgagcccggctgccgaagcgaacatctcccaagacccagaggcagcagactatctgttcaagtgcggcgcaagcaccaccatgatcggcctcgacgtgacccaccagaccgcgctcacccgtgagaaagcccatgaatgggcgtctttggggacgccggccggcgacttcctcgtcaccatgaccgactactacatcgacttctacctgaagaaccagccggagattcacggatgtggactgcacgacccgctggccgtggccgccgcgctcgacccatcgctggtcacgaccttcgggttcaacttgcaagtcgatctcgagggcccgttccgaggccgtaccatcggcgatcgttcacggctccaggatcccgacaaacacacccaagtcgcattgggcgtcaacgtgccggaattcctcgaccgtttcatgacccgcgtcaccgcggccgcgtgcgggtgaacgattacgcttcggccctgctcttttcgatttgacgtttgagatattcgcccagcccatccacgcaccaaagtgggatgttcgtcagccaagattgcttcctatagcctatttctcctatacggataccgtggagcccgtatctgttgcagacatacgagagacttctcgcacgaatattggaagaggatttcacttcgatgggaaaaacctcgtctccctgttccattacgaaatctatttccgcatttccttgaggatttgggttagcccaatagcggggtttgattccttgagctaccagctgctgacatacgtattgttctacgaacgcgcccttgaattcggaaaagagcttcgacttgttcaccagagtattcacgtcgagaccggacagtgcgcccagtatgcccgtgtcttccagatagatcttgaacgtgttaagactctcatatccggtcagaggaatatgcagagcatcgaggcaggggactttggtaatgattccgtagtccgtcagccaagtgagcgcttcctcatattcgcgggcgcgggctccttgcctgacaacaccgtaaacgaatttgcgattctccttggcaagttgtgatggcagtgtgttccatacaagccggatacgctcgcccagcgtatatgcggcatgcttggaaaaatcaagatcgtaggcgttgagaatatcttgttggacagctcgcacatcctgcggaatcccgttatccaggtgagcgcttaatgctgctggcatgccgccgacccacatatatgttttgagtaggtcattcatctgaggttcgagagcttgtggaatgtcctcgaaccggccttcacgtatggtgtcggcgatcatgtcttgtccgatgctgtccagatattcgacgaaggagagcggatgtaggttcatcatggtgacttttcctacaggaaaagaggttttgccgtgcttggatattcccatgtaggagccggtggcgatgatgtcatagtcgggtgcctgctcggtgaagtatttgagagaggtcaacgcgagcggactttcctgtatctcgtcaaagaagagcagtgttctgccggggagtatccgttggttggcggcgagttcgagctgacggattattcgttgcgggtcaagatcctgctcgaatatcccggatagggatggccgctgcatgaaatcaaccgagacgatgttgtcgtattgtccattcgcgaactcgttgacaagccatgtcttgcctgtctgccgtgcgccacggatcaggagaggcttatggtcaggtgtggtcttccactgcttgagcgttttcagtgcttttcgctggagcttcatgacggatatcctatgataaatgtgcgacgcttacacatttatcatatcataaacgtgtaagcgttacacattttttatagtttattgcagtcgcagtagttttagcgcaacggatatcagctgatcggtacgggtcttgatcgcttcggcattccatttggttatctgtgaggctcagcccatattacgcggtataagcgttaaggagcaatcaaagggcggtctttctgagattagtctcagaaagaccgccctttgcaatggaataaattgagtgtggaactcggtattggtttgaaagactgtttacagcccgggaatcagaccgccgggcggatcgagcgtgaggtattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgaaccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccaatgtcttccgggttcacgcgtacgcgaagcagttcgccgcgcgcgttctcatgagacttgacggaaacatcgtcgggaaaatcaacgatgttcttgatgaggtgttccacagcctgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggttctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcggtcagacttgatctggatggtcgagggctgggtgttggggttgtaggtaccgatctcctcgatgaccttgccgtcacgcttcttgcgggaatcgacgaccaccacgcggtagaaggcgtagaacttcttgccctgtcgcttcagacgaatcttggttgccaaaatggctctccttgtaataactaggtttgtggtttcgcggctaccatgtggggcatggcccaccggaatccacgtgtcctcgcggcccggggtgtagagggcgccacgcgcgcgcgaataactggcctattatagcgcgcagggcaggactggcgttgggtgtcgtgtgccactgccgacgcgatgtatgcatgacatattccgaagaacaatgccgcgaaacggctgacgtagacgactatcgcagtgtcaacgtggcgacgagtgccagatggtcggtgtccttgacttcgaacgatttgacgtgtgacggctgtacgccgggtgtgaacagcacgtgatccaactcgatgcgtggccacttgagccagcgggggaacgtgaggttcgggccggccgcttgggtcaggctcgcgtctttgaagccggatttcaacagggcgcggaaactcggatggtcggtgctcgagttgagatcgcccataacgacgacgatattgcgattgctgacggattttgcacgggcgagttctcgcagacccaaaatgccggccgaccaatccgcgcagccgcgcatcggcgatttcgggtgagccgaacaaagcgtcaccgtgcgattaccggaggttttgagggtgatggcgggaacgtcggaggcagggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacggtgtccatcggagatcgtttcgggcccttccttcggagtgtttgaggcacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcagcgaccgcggccagaatcatcaaaggaacccacaacagcggcgtcagggcaatcatgtacggaagcggcatacgggcctcgagaccggcgggcagcgcgcttaaggccgtccataacagtgcgatgattgccactgcgctgaggattgtcgtcatggaagttcctttcgaaatataaattgaaccgagatataacttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttgtcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccttctcatcgaactgctcgagttccttgcggtgctgggccatgcccggaatcatgccgagcagcgacttcatcgagcccagcttgcgcacctgctgcagctgatcgaggaagtcgtccaggccgaaggaaccttcggaaattttctcggcggccttgcgggcctcttcctcatcgaactgcttctgcgcctgctcgatgagcgtcatgatgtcgcccatgtcgaggatgcgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccctcgtcaaaggccttggcggtcttgacggcgtcctggccgatcatcgcgtcgatgacgaacaggatttcgttggggtgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgactacctgcagctgcgtcaccgcgttcggacgctgcaaatcggccgccaccagcagcggcgtgtggccggaatccttgagccagtagccgagcttgccggccagcgtggtcttaccggcaccctgaaggccggcgagcatgatgatcgtcggcgggttcttcgcgaagttcagcggacggtcgacgccttggccgagcacgtcggtgagctcgtcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtaccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgctttccggggaatgtgccgcgtagtagtcagggatgttgggcattcagacggcaaatgccgtgccgtccgctcgtggcgaagccaatcgagtgcttccgatatcatggaaaccgtaaagaatcctgtgttttttggaatgcttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcgtggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcggcctatacacgtattaccggcgctccaaccgctccatcggcgattccagcaccatgctcaccgccgagtgcaagagcacgttggtcgacggatcgatgtcgttcggcatcggcgcagttgccatcttcctgatgctgctaccggccggcggtccgcttgacttcctgcactacaccggcgatttcttcattaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagccgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaagtccttggccttgcgagcttcggcacgggcgttgagctgttcggcgatcagtgcctccagcgctgcatgctcgggagactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtgttgccggaacggatggcggtgaagattgcggcggttgcaccagacacattgacgtcgtcattcatggctgccacgaaatcggcgggcaaatcgtcggcggagacggcagtgacttcctcgcgagaaggctggccacccagcgccacaccggcgcgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaagggtagccggccgcacgggtctgcgccatttcgttttcgtggtgggggaagcgcagatccagaccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcgtcggccgggtcgaccggattgtatttgtcggcaccggtggcgtccacggatgggcccatgcggtcggccacggcggcggcctcatcgacttcggaggtctgcttctggtgagtaagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggctccacggtgggcggcagtacgccgagcgtgttgtatgcctcggtgaattcgcgctcgtagtaataggcgcgggcccaccaacgctggcctgcggccgcggccttatcgagaatcttgtcatcgatatcggtcacattacgcacaaaagtgactttgtagccgagcttcaaaaaccagcggcgcacgatgtcgaacgccacggcggcacggatatggccaatatgcggcgacgactgcacagtcgcgccacacacataaatgccgacttcgcccggcttgagcggcacgaaatggctgacctggtgcgaggcggtgtcatacagattcaggccttctgcggccttggcgacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcaggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgagcctcgaagacatcggtcttgagacggtgacaatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagatcgggttcgcgccgatcaagcgtgtggacaagcatgacttcttctccatgtgggataagcagctgacggtgctgcactggcataacgacgtggtgggcttgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtgggtccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattctcgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggcgaccgcttcggcatcgtcggtgcgaatggtgccggcaagtccacgctgcttaagttgattgatggcacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtcatggaggatttgctcgatacttggccgggcacgttgattgtggtctcccacgaccggtacctgctggagcgcgtcaccgatcagcagttcgccctgctcggcggcaaggtacgccatctgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggacagctccctcgtcagagggagccaataacggtgaggactccacctcgaagctcaccggcaaggccttccacgaggcatccaagcgcgtaaacgccatcgaacgtaagctcgctaagcttgaagagcagaagaccgaacttgaggcacagatggccgcccatgacccgagcgactacgagggtctcaacaagctcaatgaacaactcaccgccgtcaacactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagtttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagtccccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgatgaggtatgcacgcatgaaaaaaggcggatatgcatcatgcacatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcgccatcgagcaggttggtctgcgagtagtggtgctcgtagaacagcgtctgccactgacggaccatgccgtatacggagttgttcagaatcgcgatcttcaccggagcgtggtccaggaacgcggcggccagctcctcagaggtcatctggaaggaaccgtcaccatcgatcagccacaccggcttcttgccctcgaattcacgggccgagcccacggatgcgccgatggcagccggcaggccgtagcccatcgtgccgaggcctccggaggagatccaagcgtgctggttctcaaaatcgatgaactgcgaagcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgtacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggcggccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcactcggcctgctcgccgttctgctcggcctcgagctgggctttgagccccgccaatccggcaaaacggatatccgtcacatcgtgatgatggtcgggatcctcgttcagatcggcaccacactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctggcccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttattcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggcaaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccgggggcgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatgcgaggaaagaagtgcaccatgacttttgccgatctgttcaccaatgacgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtccccaagcacgacccgtccaagtacccggtttgccccgactgcaagcggatttacgaggaaatgacgcgctaaaggtggtacttggctcccctcagcgaggggagccaaaatggtcaccgagccgaaatctcgtcgatgagcttgagctcctcgtcgctgaagtgggtgttcttcagcgcgccgatgttgtcgagaatctgctgcggcttggaggctccggtcagcacggaggtcactttgccgtcgtgcagcagccatgccaggctcatctcggccagcgtctggccgcgttcggcggccagattgttcagatccatgacctgcttgtgcagtttctcggtcagagcggaatcgttgaggaatcgcggatcgtgagccatgcggctgtcggccggaatgccgttgagatagcggttggtcagcaggccctgagccagcgggcagaaggtgataaggcctttgcctagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccggatccgggtggtggtggtagaagatgtccacataatccaagcccaagcgttccagcgactggtcgaggctggcgagcaggtacttgcggctgccgaggtcgccataggggcctgtccacatttcgtagccggccttggtggagatgacgagttcgtcgcggtgatgtttgaaatacttggcgagcagcagtccgcagttcttctcggcctggccgggttcggggccgtagttgttggctaggtcgaagtgggtgatgccgttgtcgaaggcggtgaagaccaaggacttcatctggtcgaatggcgtgatgtcgccgaagttgtgccagaagccgagtgagacggccggcaacttgaggccggaggtgccggcacggttgtaggtcatcgtgtcgtaacggtgcgggttgggggcatagatggcggttggctcgaacattgagtctccttacaatgtcattcttgttcttacgaatgcttacctgcgatgggcaaaccgacgctgattgagcggtattcgtaagtgttcttggatactatggttccagttcaagtgaacttgaatgcaaacggctgcgacgcttcggcgtgttgccgcagtaaggagtcatgatgtcctacaccattcgtcaggtggccacgcaattccatatgcagccctctacgctgcgctattacgaggatcagggattgctgaccaacgtggagcgcaccgaaaccggccagcgtatatacgaagactgccatatcgaccgtctgcgcgcgatttgctgcttcaagaacgccggcatgaccattgacgatcttaagaagttcttcgtgtatgagtccaatgagcccgagcatatcgacgaaatccttgatctgctggaatctcgccgcgaatccttggacgagcagcgccgagccctcaacgaggcggccatgcacgtgcagcgcaagctccattactatggcgacatcaagcgtgccatcgacgccggtgaagactggccggattggcgcgagtacaaaaaccgcgcctattccattgaatgttgagtccatcgagtgctgaggccatcgaatgttgaggccatcgagtgctgtgttggataccggctgggcaccaagaccgatgtgcgtcgatcatgggcgcgtctatccgagtaaggccttgctcggcagtgcgcggtcgagcagccagacaacgagcgatatcacgaagaacgctatggccagcttgccgcagctaatgccgaacccttgccagtcgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcatcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggccgtatggtgcggctggcgtattggctggtcgtgatgattatggtcggtgtgaccgaccgccatagtgccgatggatatgacgatactgaacccggcaatatcgaatctggcgatacgagaataagacgagcccttcccgcacggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccatcggcaccgccgcgcattgcttcacgttggtgcatgattccgagcgtgacgcctttgaatcgcagatcgaggcattgggcaagaacaccacgctgctggtggacacctacaacatcgaggaagccgtgaaaaccgccgtcgaagtggccggtcccgaactgggtggcgtgcgcatcgactccggcgacctagccgccatggcccagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggataaggccacagtgcccggtcgcaagttggcattccgctcctacgaatacgcgctagccgaagccgaacacgtgatttccggctcggaagagaaactggccggtttcacgcccgaaccgacgtggaagaacctgctggtcgatttcgtggaccacggccatatcgatgcgcagtggcagggccatgacgccatcatggccgcccacgactaccgcgccaaggcgttgtccgaactgcccatcaccgcacaaagcctgatgaagggcgagcccgtgattcctacggagactcaggttctctgacgagaactttcgtctccataggaatccgtcgcagcatagctgctccccttacctacggacagcccactgggctgtccgcttaacggttcgaccacagagaccaaagtcctctgaccgtatcgcactggccgcatccctctggttacattggctactcttccctctgtctgtgcccctctgtctgtgttggccgcactcctgtggtcgccgccgaggcggggagatgcaaccccggtcgcacccccgtgtttgcaccccctgtggctgtgtcccggggctgtattggccgcgtcccctcgggctgaactgcgtcccggttcgccggacgtggttccagctgagggtgcccccttgtttttttgggggggtgttcctatgtttttgtcaactccttggggagttgacgtgtcgggat
